US011578329B2

(12) United States Patent
Saxena et al.

(10) Patent No.: US 11,578,329 B2
(45) Date of Patent: Feb. 14, 2023

(54) COMPOSITIONS AND METHODS FOR INHIBITING NUCLEAR RECEPTOR SUBFAMILY 1 GROUP H MEMBER 3 (NR1H3) EXPRESSION

(71) Applicants: Novo Nordisk A/S, Bagsvaerd (DK); Dicerna Pharmaceuticals, Inc., Lexington, MA (US)

(72) Inventors: Utsav Saxena, Watertown, MA (US); Henryk Dudek, Belmont, MA (US); Natalie Wayne Pursell, Westborough, MA (US); Nicole Alexis Spiegelman, Somerville, MA (US); Markus Robert Latta, Hvidovre (DK); Birgitte Andersen, Maaloev (DK)

(73) Assignees: Novo Nordisk A/S, Bagsvaerd (DK); Dicerna Pharmaceuticals, Inc., Lexington, MA (US)

( * ) Notice: Subject to any disclaimer, the term of this patent is extended or adjusted under 35 U.S.C. 154(b) by 0 days.

(21) Appl. No.: 17/724,176

(22) Filed: Apr. 19, 2022

(65) Prior Publication Data

US 2022/0340912 A1 Oct. 27, 2022

Related U.S. Application Data

(60) Provisional application No. 63/176,814, filed on Apr. 19, 2021.

(30) Foreign Application Priority Data

Jul. 19, 2021 (EP) ..................................... 21186366
Dec. 10, 2021 (EP) ..................................... 21213711

(51) Int. Cl.
| | | |
|---|---|---|
| *C12N 15/113* | (2010.01) | |
| *A61P 1/16* | (2006.01) | |
| *A61P 3/06* | (2006.01) | |

(52) U.S. Cl.
CPC ............ *C12N 15/1138* (2013.01); *A61P 1/16* (2018.01); *A61P 3/06* (2018.01); *C12N 2310/11* (2013.01); *C12N 2310/14* (2013.01); *C12N 2310/351* (2013.01); *C12N 2310/531* (2013.01)

(58) Field of Classification Search
None
See application file for complete search history.

(56) References Cited

U.S. PATENT DOCUMENTS

| 7,807,815 B2 | 10/2010 | MacLachlan et al. |
| 2005/0245475 A1 | 11/2005 | Khvorova et al. |
| 2005/0255487 A1 | 11/2005 | Khvorova et al. |
| 2008/0076908 A1 | 3/2008 | Khvorova et al. |
| 2008/0113351 A1 | 5/2008 | Naito et al. |
| 2009/0306184 A1 | 12/2009 | Mcswiggen et al. |

FOREIGN PATENT DOCUMENTS

| EP | 1948674 A1 | 7/2008 |
| WO | 2002085308 A2 | 10/2002 |
| WO | 2002085309 A2 | 10/2002 |
| WO | 2003070750 A2 | 8/2003 |
| WO | 2005028650 A2 | 3/2005 |
| WO | 2005116204 A1 | 12/2005 |
| WO | 2005116250 A2 | 12/2005 |
| WO | 2006006948 A2 | 1/2006 |
| WO | 2009099991 A2 | 8/2009 |
| WO | 2010048352 A2 | 4/2010 |
| WO | 2012092485 A1 | 7/2012 |
| WO | 2014085453 A2 | 6/2014 |
| WO | 2019006375 A1 | 1/2019 |
| WO | 2019079781 A2 | 4/2019 |
| WO | 2020006267 A1 | 1/2020 |

OTHER PUBLICATIONS

Bessone et al., "Molecular pathways of nonalcoholic fatty liver disease development and progression" Cell Mol Life Sci, Jan. 2019, vol. 76, No. 1, pp. 99-128.
Bradley et al., "Ligand activation of LXR? reverses atherosclerosis and cellular cholesterol overload in mice lacking LXR? and apoE", Journal of Clinical Investigation, Aug. 2007, vol. 117, No. 8, pp. 2337-2346.
Brooks, III et al., "Therapeutic potential of dithiolethiones for hepatic diseases", Pharmacol Ther., Oct. 2009, vol. 124, No. 1, pp. 31-43.
Chalasani et al., "The diagnosis and management of non-alcoholic fatty liver disease: practice Guideline by the American Association for the Study of Liver Diseases, American College of Gastroenterology, and the American Gastroenterological Association", Hepatology, Jun. 2012, vol. 55, No. 6, pp. 2005-2023.
Groot et al., "Synthetic LXR agonists increase LDL in CETP species", The Journal of Lipid Research, 2005, vol. 46, pp. 2182-2191.
Hong et al., "The LXR-Idol Axis Differentially Regulates Plasma LDL Levels in Primates and Mice", Cell Metabolism, Nov. 4, 2014, vol. 20, No. 5, pp. 910-918.
Kim et al., "Randomised clinical trial: the efficacy and safety of oltipraz, a liver X receptor alpha-inhibitory dithiolethione in patients with non-alcoholic fatty liver disease", Aliment Pharmacol Ther. Apr. 2017, vol. 45, No. 8, pp. 1073-1083.
Kirchgessner et al., "Beneficial and Adverse Effects of an LXR Agonist on Human Lipid and Lipoprotein Metabolism and Circulating Neutrophils", Cell Metabolism, Aug. 9, 2016, vol. 24, No. 2, pp. 223-233.

(Continued)

*Primary Examiner* — Sean McGarry
(74) *Attorney, Agent, or Firm* — Jianjie Hu

(57) ABSTRACT

Oligonucleotides are provided herein that inhibit NR1H3 expression. Also provided are compositions including the same and uses thereof, particularly uses relating to treating diseases, disorders and/or conditions associated with NR1H3 expression.

30 Claims, 6 Drawing Sheets

Specification includes a Sequence Listing.

(56) References Cited

OTHER PUBLICATIONS

Kirchgessner et al., "Pharmacological Characterization of a Novel Liver X Receptor Agonist with Partial LXRa Activity and a Favorable Window in Nonhuman Primates", Journal Pharmacology and Experimental Therapeutics, Feb. 2015, vol. 352, pp. 305-314.
Loomba et al., "The global NAFLD epidemic", Nat Rev Gastroenterol Hepatol, Nov. 2013, vol. 10, No. 11, pp. 686-690.
Patil et al., "Non-alcoholic fatty liver disease and cardiovascular risk", World J Gastrointest Pathophysiol, May 2017, vol. 8, No. 2, pp. 51-58.
Peet et al., "Cholesterol and Bile Acid Metabolism are Impaired in Mice Lacking the Nuclear Oxysterol Receptor LXR?", Cell, May 29, 1998, vol. 93, No. 5, pp. 693-704.
Schultz et al., "Role of LXRs in control of lipogenesis", Genes Dev., Nov. 15, 2000, vol. 14, No. 22, pp. 2831-2838.
Yu et al., "Involvement of Liver X Receptor Alpha in Histone Modifications X Across the Target Fatty Acid Synthase Gene", LIPIDS, Dec. 8, 2011, vol. 47, No. 3, (Dec. 8, 2011), pp. 249-257.
Zhang et al., "Liver LXR? expression is crucial for whole body cholesterol homeostasis and reverse cholesterol transport in mice", Journal of Clinical Investigation, May 2012, vol. 122, No. 5, pp. 1688-1699.
Zhao et al., "LXRα gene downregulation by lentiviral-based RNA interference enhances liver function after fatty liver transplantation in rats", Hepatobiliary & Pancreatic Diseases International, Aug. 2015, vol. 14, No. 4, pp. 386-393.

COMPOSITIONS AND METHODS FOR INHIBITING NUCLEAR RECEPTOR SUBFAMILY 1 GROUP H MEMBER 3 (NR1H3) EXPRESSION

CROSS-REFERENCE TO RELATED APPLICATIONS

This application claims priority to European Patent Applications 21213711.1, filed Dec. 10, 2021 and 21186366.7, filed Jul. 19, 2021, and claims priority to U.S. Provisional Patent Application 63/176,814, filed Apr. 19, 2021; the contents of which are incorporated herein by reference.

SEQUENCE LISTING

The instant application contains a Sequence Listing which has been submitted in ASCII format via EFS-Web and is hereby incorporated by reference in its entirety. Said ASCII copy, created on Apr. 19, 2022, is named 210010US02_SeqList.txt and is 700 kilobytes in size.

BACKGROUND

The liver plays a critical role in the metabolism of lipids. Abnormalities in normal hepatic lipid metabolism are associated with the development of various liver diseases or disorders such as non-alcoholic fatty liver disease (NAFLD) and its subsequent progression to non-alcoholic steatohepatitis (NASH) and potentially other advanced liver abnormalities.

NAFLD is one of the most common liver diseases, with increasing prevalence worldwide (Loomba R., & Sanyal A. J. NAT. REV. GASTROENTEROL HEPATOL. (2013); 10(11): 686-90). NAFLD is a liver disease characterized by a spectrum of clinical and pathological severity ranging from simple steatosis to nonalcoholic fatty liver (NAFL), nonalcoholic steatohepatitis (NASH), fibrosis, cirrhosis, hepatocellular carcinoma (HCC) and liver failure (Bessone F, et al., CELL MOL. LIFE SCI. (2019); 76(1): 99-128). NAFLD is characterized by the presence of fat in the liver in the absence of significant alcohol use and other causes of fat accumulation in the liver such as medications, starvation, and viral disease (Chalasani, N., et al., HEPATOLOGY (Baltimore, Md.), (2012); 55(6): 2005-23). Additionally, as the disease progresses, NASH patients also have an increased risk of developing extra-hepatic complications, particularly cardiovascular diseases (CVD), which are among the most common causes of death in this patient population (Patil R, et al., WORLD J. GASTROINTEST. PATHOPHYSIOL. (2017); 8(2): 51-8). The abnormalities in hepatic lipid metabolism that lead to NAFLD also drive the progression of atherogenic dyslipidemia, where elevated plasma triglycerides (TG) cholesterol and lipoprotein particles infiltrate the arterial wall and subsequently develop atherosclerotic plaques (Loomba R & Sanyal A J NAT. REV. GASTROENTEROL. HEPATOL. (2013); 10(11): 686-90). Thus, there is a significant medical need for the development of disease modifying therapeutics for NAFLD.

SUMMARY OF DISCLOSURE

The disclosure is based in part on the discovery of oligonucleotides (e.g., RNAi oligonucleotides) that reduce NR1H3 (nuclear receptor subfamily 1, group H, member 3) expression in the liver. Specifically, target sequences within NR1H3 mRNA were identified and oligonucleotides that bind to these target sequences and inhibit NR1H3 mRNA expression were generated. As demonstrated herein, the oligonucleotides inhibited murine, monkey and/or human NR1H3 expression in the liver. Without being bound by theory, the oligonucleotides described herein are useful for treating a disease, disorder or condition associated with NR1H3 expression (e.g., non-alcoholic fatty liver disease (NAFLD), non-alcoholic steatohepatitis (NASH), or systemic lupus erythematosus).

In an aspect, the invention provides an RNAi oligonucleotide for reducing NR1H3 expression, the oligonucleotide comprising a sense strand and an antisense strand, wherein the sense strand and the antisense strand form a duplex region, wherein the antisense strand comprises a region of complementarity to a NR1H3 mRNA target sequence of any one of SEQ ID NOs: 1-384, and wherein the region of complementarity is at least 15 contiguous nucleotides in length. In an aspect, the invention provides an RNAi oligonucleotide for reducing NR1H3 expression, the oligonucleotide comprising a sense strand and an antisense strand, wherein the sense strand and the antisense strand form a duplex region, wherein the antisense strand comprises a region of complementarity to a NR1H3 mRNA target sequence of any one of SEQ ID NOs: 1125-1511, and wherein the region of complementarity is at least 15 contiguous nucleotides in length.

In some embodiments, the RNAi oligonucleotide comprises (i) an antisense strand of 19-30 nucleotides in length, wherein the antisense strand comprises a nucleotide sequence comprising a region of complementarity to a NR1H3 mRNA target sequence, wherein the region of complementarity is selected from SEQ ID NOs: 786, 787, 1537 and 813, and (ii) a sense strand of 19-50 nucleotides in length comprising a region of complementarity to the antisense strand, wherein the antisense and sense strands are separate strands which form an asymmetric duplex region having an overhang of 1-4 nucleotides at the 3' terminus of the antisense strand.

In some embodiments, the RNAi oligonucleotide comprises (i) an antisense strand of 19-30 nucleotides in length, wherein the antisense strand comprises a nucleotide sequence comprising a region of complementarity to a NR1H3 mRNA target sequence, wherein the region of complementarity is selected from SEQ ID NOs: 1509, 1510 1409, and 1511 and (ii) a sense strand of 19-50 nucleotides in length comprising a region of complementarity to the antisense strand, wherein the antisense and sense strands are separate strands which form an asymmetric duplex region having an overhang of 1-4 nucleotides at the 3' terminus of the antisense strand.

In some embodiments of the RNAi oligonucleotide: (i) the sense strand is 15 to 50 or 18 to 36 nucleotides in length, optionally 36 nucleotides in length; optionally (ii) the antisense strand is 15 to 30 nucleotides in length, optionally 22 nucleotides in length; and optionally (iii) the duplex region is at least 19 nucleotides or at least 20 nucleotides in length.

In some embodiments of the RNAi oligonucleotide, the region of complementarity is at least 19 contiguous nucleotides in length, optionally at least 20 contiguous nucleotides in length, optionally 20 contiguous nucleotides, and optionally wherein the region of complementarity is fully complementary to the mRNA target sequence at nucleotide positions 2-8 of the antisense strand or positions 2-11 of the antisense strand, nucleotide numbering 5' to 3'.

In some embodiments of the RNAi oligonucleotide: the 3' end of the sense strand comprises a stem-loop set forth as S1-L-S2, wherein (i) S1 is complementary to S2, optionally wherein S1 and S2 are each 1-10 nucleotides in length and have the same length, optionally wherein S1 and S2 are each 1, 2, 3, 4, 5, 6, 7, 8, 9, or 10 nucleotides in length, further optionally wherein S1 and S2 are 6 nucleotides in length; and (ii) L forms a loop between S1 and S2 of 3-5 nucleotides in length, optionally wherein L is a triloop or a tetraloop, optionally wherein the tetraloop comprises the sequence 5'-GAAA-3', optionally wherein the stem-loop comprises the sequence 5'-GCAGCCGAAAGGCUGC-3' (SEQ ID NO: 1121). In some embodiments of the RNAi oligonucleotide comprises a nicked tetraloop structure or comprises a nick between the 3' terminus of the sense strand and the 5' terminus of the antisense strand.

In some embodiments of the RNAi oligonucleotide: the antisense strand comprises an overhang sequence of one or more nucleotides in length at the 3' terminus, optionally wherein the overhang comprises purine nucleotides, optionally wherein the overhang sequence is 2 nucleotides in length, optionally wherein the overhang is selected from AA, GG, AG, and GA, optionally wherein the overhang is GG.

In some embodiments of the RNAi oligonucleotide: (i) the oligonucleotide comprises at least one modified nucleotide, optionally wherein the modified nucleotide comprises a 2'-modification, optionally wherein: (a) the 2'-modification is a modification selected from 2'-aminoethyl, 2'-fluoro, 2'-O-methyl, 2'-O-methoxyethyl, and 2'-deoxy-2'-fluoro-3-d-arabinonucleic acid, optionally wherein the modification is selected from 2'-fluoro and 2'-O-methyl, optionally wherein all nucleotides of the oligonucleotide are modified, wherein the modification is 2'-fluoro and 2'-O-methyl; (b) about 10-15%, 10%, 11%, 12%, 13%, 14%, or 15% of the nucleotides of the sense strand comprise a 2'-fluoro modification; (c) about 25-35%, 25%, 26%, 27%, 28%, 29%, 30%, 31%, 32%, 33%, 34%, or 35% of the nucleotides of the antisense strand comprise a 2'-fluoro modification; (d) about 25-35%, 25%, 26%, 27%, 28%, 29%, 30%, 31%, 32%, 33%, 34%, or 35% of the nucleotides of the oligonucleotide comprise a 2'-fluoro modification; (e) the sense strand comprises 36 nucleotides with positions 1-36 from 5' to 3', wherein positions 8-11 comprise a 2'-fluoro modification; (f) the antisense strand comprises 22 nucleotides with positions 1-22 from 5' to 3', and wherein positions 2, 3, 4, 5, 7, 10, and 14 comprise a 2'-fluoro modification; and/or (g) the remaining nucleotides comprise a 2'-O-methyl modification, and/or (ii) the oligonucleotide comprises at least one modified internucleotide linkage, optionally wherein the at least one modified internucleotide linkage is a phosphorothioate linkage, optionally wherein: (a) the antisense strand comprises a phosphorothioate linkage (i) between positions 1 and 2, and between positions 2 and 3; or (ii) between positions 1 and 2, between positions 2 and 3, and between positions 3 and 4, wherein positions are numbered 1-4 from 5' to 3'; and/or (b) the antisense strand is 22 nucleotides in length, and wherein the antisense strand comprises a phosphorothioate linkage between positions 20 and 21 and between positions 21 and 22, wherein positions are numbered 1-22 from 5' to 3', and/or (iii) the antisense strand comprises a phosphorylated nucleotide at the 5' terminus, wherein the phosphorylated nucleotide is selected from uridine and adenosine, optionally wherein the phosphorylated nucleotide is uridine, and/or (iv) the 4'-carbon of the sugar of the 5'-nucleotide of the antisense strand comprises a phosphate analog, optionally wherein the phosphate analog is oxymethylphosphonate, vinylphosphonate or malonylphosphonate, optionally wherein the phosphate analog is a 4'-phosphate analog comprising 5'-methoxyphosphonate-4'-oxy, and/or (v) at least one nucleotide of the oligonucleotide is conjugated to one or more targeting ligands, optionally wherein: (a) each targeting ligand comprises a carbohydrate, amino sugar, cholesterol, polypeptide or lipid; (b) the stem loop comprises one or more targeting ligands conjugated to one or more nucleotides of the stem loop; (c) the one or more targeting ligands is conjugated to one or more nucleotides of the loop, optionally wherein the loop comprises 4 nucleotides numbered 1-4 from 5' to 3', wherein nucleotides at positions 2, 3, and 4 each comprise one or more targeting ligands, wherein the targeting ligands are the same or different; (d) each targeting ligand comprises a N-acetylgalactosamine (GalNAc) moiety, optionally wherein the GalNAc moiety is a monovalent GalNAc moiety, a bivalent GalNAc moiety, a trivalent GalNAc moiety or a tetravalent GalNAc moiety; and/or (e) up to 4 nucleotides of L of the stem-loop are each conjugated to a monovalent GalNAc moiety.

In some embodiments of the RNAi oligonucleotide, the targeting ligand comprises at least one GalNAc moiety and targets human liver cells (e.g., human hepatocytes).

In some embodiments of the RNAi oligonucleotide: (i) the sense strand comprises a nucleotide sequence of any one of SEQ ID NOs: 769-856, SEQ ID NOs: 1519-1552, SEQ ID NOs: 1409, 1509-1511, or SEQ ID NOs: 945-1032, optionally a nucleotide sequence selected from SEQ ID NOs: SEQ ID NOs: 786, 787, 813, and 1537; and optionally (ii) the antisense strand comprises a nucleotide sequence of any one of SEQ ID NOs: 857-944 or SEQ ID NOs: 1033-1120, optionally a nucleotide sequence selected from SEQ ID NOs: 874, 875, 901, and 929.

In some embodiments of the RNAi oligonucleotide: the sense strand and antisense strands comprise nucleotide sequences selected from the group consisting of:

(a) SEQ ID NOs: 769 and 857, respectively;
(b) SEQ ID NOs: 770 and 858, respectively;
(c) SEQ ID NOs: 771 and 859, respectively;
(d) SEQ ID NOs: 772 and 860, respectively;
(e) SEQ ID NOs: 773 and 861, respectively;
(f) SEQ ID NOs: 774 and 862, respectively;
(g) SEQ ID NOs: 775 and 863, respectively;
(h) SEQ ID NOs: 776 and 864, respectively;
(i) SEQ ID NOs: 777 and 865, respectively;
(j) SEQ ID NOs: 778 and 866, respectively;
(k) SEQ ID NOs: 779 and 867, respectively;
(l) SEQ ID NOs: 780 and 868, respectively;
(m) SEQ ID NOs: 781 and 869, respectively;
(n) SEQ ID NOs: 782 and 870, respectively;
(o) SEQ ID NOs: 783 and 871, respectively;
(p) SEQ ID NOs: 784 and 872, respectively;
(q) SEQ ID NOs: 785 and 873, respectively;
(r) SEQ ID NOs: 786 and 874, respectively;
(s) SEQ ID NOs: 787 and 875, respectively;
(t) SEQ ID NOs: 788 and 876, respectively;
(u) SEQ ID NOs: 789 and 877, respectively;
(v) SEQ ID NOs: 790 and 878, respectively;
(w) SEQ ID NOs: 791 and 879, respectively;
(x) SEQ ID NOs: 792 and 880, respectively;
(y) SEQ ID NOs: 793 and 881, respectively;
(z) SEQ ID NOs: 794 and 882, respectively;
(aa) SEQ ID NOs: 795 and 883, respectively;
(bb) SEQ ID NOs: 796 and 884, respectively;
(cc) SEQ ID NOs: 797 and 885, respectively;
(dd) SEQ ID NOs: 798 and 886, respectively;
(ee) SEQ ID NOs: 799 and 887, respectively;
(ff) SEQ ID NOs: 800 and 888, respectively;
(gg) SEQ ID NOs: 801 and 889, respectively;
(hh) SEQ ID NOs: 802 and 890, respectively;

(ii) SEQ ID NOs: 803 and 891, respectively;
(jj) SEQ ID NOs: 804 and 892, respectively;
(kk) SEQ ID NOs: 805 and 893, respectively;
(ll) SEQ ID NOs: 806 and 894, respectively;
(mm) SEQ ID NOs: 807 and 895, respectively;
(nn) SEQ ID NOs: 808 and 896, respectively;
(oo) SEQ ID NOs: 809 and 897, respectively;
(pp) SEQ ID NOs: 810 and 898, respectively;
(qq) SEQ ID NOs: 811 and 899, respectively;
(rr) SEQ ID NOs: 812 and 900, respectively;
(ss) SEQ ID NOs: 813 and 901, respectively;
(tt) SEQ ID NOs: 814 and 902, respectively;
(uu) SEQ ID NOs: 815 and 903, respectively;
(vv) SEQ ID NOs: 816 and 904, respectively;
(ww) SEQ ID NOs: 817 and 905, respectively;
(xx) SEQ ID NOs: 818 and 906, respectively;
(yy) SEQ ID NOs: 819 and 907, respectively;
(zz) SEQ ID NOs: 820 and 908, respectively;
(aaa) SEQ ID NOs: 821 and 909, respectively;
(bbb) SEQ ID NOs: 822 and 910, respectively;
(ccc) SEQ ID NOs: 823 and 911, respectively;
(ddd) SEQ ID NOs: 824 and 912, respectively;
(eee) SEQ ID NOs: 825 and 913, respectively;
(fff) SEQ ID NOs: 826 and 914, respectively;
(ggg) SEQ ID NOs: 827 and 915, respectively;
(hhh) SEQ ID NOs: 828 and 916, respectively;
(iii) SEQ ID NOs: 829 and 917, respectively;
(jjj) SEQ ID NOs: 830 and 918, respectively;
(kkk) SEQ ID NOs: 831 and 919, respectively;
(lll) SEQ ID NOs: 832 and 920, respectively;
(mmm) SEQ ID NOs: 833 and 921, respectively;
(nnn) SEQ ID NOs: 834 and 922, respectively;
(ooo) SEQ ID NOs: 835 and 923, respectively;
(ppp) SEQ ID NOs: 836 and 924, respectively;
(qqq) SEQ ID NOs: 837 and 925, respectively;
(rrr) SEQ ID NOs: 838 and 926, respectively;
(sss) SEQ ID NOs: 839 and 927, respectively;
(ttt) SEQ ID NOs: 840 and 928, respectively;
(uuu) SEQ ID NOs: 1537 and 929, respectively;
(vvv) SEQ ID NOs: 842 and 930, respectively;
(www) SEQ ID NOs: 843 and 931, respectively;
(xxx) SEQ ID NOs: 844 and 932, respectively;
(yyy) SEQ ID NOs: 845 and 933, respectively;
(zzz) SEQ ID NOs: 846 and 934, respectively;
(aaaa) SEQ ID NOs: 847 and 935, respectively;
(bbbb) SEQ ID NOs: 848 and 936, respectively;
(cccc) SEQ ID NOs: 849 and 937, respectively;
(dddd) SEQ ID NOs: 850 and 938, respectively;
(eeee) SEQ ID NOs: 851 and 939, respectively;
(ffff) SEQ ID NOs: 852 and 940, respectively;
(gggg) SEQ ID NOs: 853 and 941, respectively;
(hhhh) SEQ ID NOs: 854 and 942, respectively;
(iiii) SEQ ID NOs: 855 and 943, respectively; and,
(jjjj) SEQ ID NOs: 856 and 944, respectively.

In some embodiments of the RNAi oligonucleotide: the sense and antisense strands comprise nucleotide sequences selected from the group consisting of:
(a) SEQ ID NOs: 945 and 1033, respectively;
(b) SEQ ID NOs: 946 and 1034, respectively;
(c) SEQ ID NOs: 947 and 1035, respectively;
(d) SEQ ID NOs: 948 and 1036, respectively;
(e) SEQ ID NOs: 949 and 1037, respectively;
(f) SEQ ID NOs: 950 and 1038, respectively;
(g) SEQ ID NOs: 951 and 1039, respectively;
(h) SEQ ID NOs: 952 and 1040, respectively;
(i) SEQ ID NOs: 953 and 1041, respectively;
(j) SEQ ID NOs: 954 and 1042, respectively;
(k) SEQ ID NOs: 955 and 1043, respectively;
(l) SEQ ID NOs: 956 and 1044 respectively;
(m) SEQ ID NOs: 957 and 1045, respectively;
(n) SEQ ID NOs: 958 and 1046, respectively;
(o) SEQ ID NOs: 959 and 1047, respectively;
(p) SEQ ID NOs: 960 and 1048, respectively;
(q) SEQ ID NOs: 961 and 1049, respectively;
(r) SEQ ID NOs: 962 and 1050, respectively;
(s) SEQ ID NOs: 963 and 1051, respectively;
(t) SEQ ID NOs: 964 and 1052, respectively;
(u) SEQ ID NOs: 965 and 1053, respectively;
(v) SEQ ID NOs: 966 and 1054, respectively;
(w) SEQ ID NOs: 967 and 1055, respectively;
(x) SEQ ID NOs: 968 and 1056, respectively;
(y) SEQ ID NOs: 969 and 1057, respectively;
(z) SEQ ID NOs: 970 and 1058, respectively;
(aa) SEQ ID NOs: 971 and 1059, respectively;
(bb) SEQ ID NOs: 972 and 1060, respectively;
(cc) SEQ ID NOs: 973 and 1061, respectively;
(dd) SEQ ID NOs: 974 and 1062, respectively;
(ee) SEQ ID NOs: 975 and 1063, respectively;
(ff) SEQ ID NOs: 976 and 1064, respectively;
(gg) SEQ ID NOs: 977 and 1065, respectively;
(hh) SEQ ID NOs: 978 and 1066, respectively;
(ii) SEQ ID NOs: 979 and 1067, respectively;
(jj) SEQ ID NOs: 980 and 1068, respectively;
(kk) SEQ ID NOs: 981 and 1069, respectively;
(ll) SEQ ID NOs: 982 and 1070, respectively;
(mm) SEQ ID NOs: 983 and 1071, respectively;
(nn) SEQ ID NOs: 984 and 1072, respectively;
(oo) SEQ ID NOs: 985 and 1073, respectively;
(pp) SEQ ID NOs: 986 and 1074, respectively;
(qq) SEQ ID NOs: 987 and 1075, respectively;
(rr) SEQ ID NOs: 988 and 1076, respectively;
(ss) SEQ ID NOs: 989 and 1077, respectively;
(tt) SEQ ID NOs: 990 and 1078, respectively;
(uu) SEQ ID NOs: 991 and 1079, respectively;
(vv) SEQ ID NOs: 992 and 1080, respectively;
(ww) SEQ ID NOs: 993 and 1081, respectively;
(xx) SEQ ID NOs: 994 and 1082, respectively;
(yy) SEQ ID NOs: 995 and 1083, respectively;
(zz) SEQ ID NOs: 996 and 1084, respectively;
(aaa) SEQ ID NOs: 997 and 1085, respectively;
(bbb) SEQ ID NOs: 998 and 1086, respectively;
(ccc) SEQ ID NOs: 999 and 1087, respectively;
(ddd) SEQ ID NOs: 1000 and 1088, respectively;
(eee) SEQ ID NOs: 1001 and 1089, respectively;
(fff) SEQ ID NOs: 1002 and 1090, respectively;
(ggg) SEQ ID NOs: 1003 and 1091, respectively;
(hhh) SEQ ID NOs: 1004 and 1092 respectively;
(iii) SEQ ID NOs: 1005 and 1093 respectively;
(jjj) SEQ ID NOs: 1006 and 1094, respectively;
(kkk) SEQ ID NOs: 1007 and 1095, respectively;
(lll) SEQ ID NOs: 1008 and 1096, respectively;
(mmm) SEQ ID NOs: 1009 and 1097, respectively;
(nnn) SEQ ID NOs: 1010 and 1098, respectively;
(ooo) SEQ ID NOs: 1011 and 1099, respectively;
(ppp) SEQ ID NOs: 1012 and 1100, respectively;
(qqq) SEQ ID NOs: 1013 and 1101, respectively;
(rrr) SEQ ID NOs: 1014 and 1102 respectively;
(sss) SEQ ID NOs: 1015 and 1103, respectively;
(ttt) SEQ ID NOs: 1016 and 1104, respectively;
(uuu) SEQ ID NOs: 1017 and 1105, respectively;
(vvv) SEQ ID NOs: 1018 and 1106, respectively;
(www) SEQ ID NOs: 1019 and 1107, respectively;
(xxx) SEQ ID NOs: 1020 and 1108, respectively;
(yyy) SEQ ID NOs: 1021 and 1109, respectively;
(zzz) SEQ ID NOs: 1022 and 1110, respectively;
(aaaa) SEQ ID NOs: 1023 and 1111, respectively;
(bbbb) SEQ ID NOs: 1024 and 1112, respectively;
(cccc) SEQ ID NOs: 1025 and 1113, respectively;
(dddd) SEQ ID NOs: 1026 and 1114, respectively;
(eeee) SEQ ID NOs: 1027 and 1115, respectively;
(ffff) SEQ ID NOs: 1028 and 1116, respectively;
(gggg) SEQ ID NOs: 1029 and 1117, respectively;

(hhhh) SEQ ID NOs: 1030 and 1118, respectively;
(iiii) SEQ ID NOs: 1031 and 1119, respectively; and,
(jjjj) SEQ ID NOs: 1032 and 1120, respectively.

In some embodiments of the RNAi oligonucleotide:

(i) the sense strand comprises the sequence and all of the modifications of 5'-mCs-mU-mC-mA-mA-mG-mG-fA-fU-fU-fU-mC-mA-mG-mU-mU-mA-mU-mA-mA-mG-mC-mA-mG-mC-mC-mG-[ademA-GalNAc]-[ademA-GalNAc]-[ademA-GalNAc]-mG-mG-mC-mU-mG-mC-3' (SEQ ID NO: 963), and wherein the antisense strand comprises the sequence and all of the modifications of 5'-[MePhosphonate-40-mUs]-fUs-fAs-fU-fA-mA-fC-mU-mG-fA-mA-mA-mU-fC-mC-mU-mU-mG-mA-mGs-mGs-mG-3' (SEQ ID NO: 1051), wherein mC, mA, mG, and mU=2'-OMe ribonucleosides; fA, fC, fG, and fU=2'-F ribonucleosides; s=phosphorothioate, and wherein ademA-GalNAc=Chem. formula 5

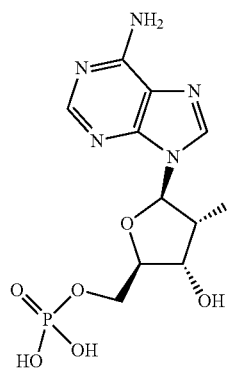
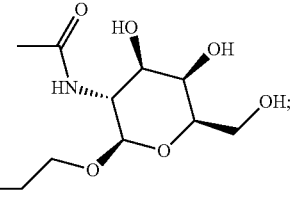

(ii) the sense strand comprises the sequence and all of the modifications of 5'-mUs-mC-mA-mA-mG-mG-mA-fU-fU-fU-fC-mA-mG-mU-mU-mA-mU-mA-mA-mA-mG-mC-mA-mG-mC-mC-mG-[ademA-GalNAc]-[ademA-GalNAc]-[ademA-GalNAc]-mG-mG-mC-mU-mG-mC-3' (SEQ ID NO: 964), and wherein the antisense strand comprises the sequence and all of the modifications of 5'-[MePhosphonate-40-mUs]-fUs-fUs-fA-fU-mA-fA-mC-mU-fG-mA-mA-mA-fU-mC-mC-mU-mU-mG-mAs-mGs-mG-3' (SEQ ID NO: 1052), wherein mC, mA, mG, and mU=2'-OMe ribonucleosides; fA, fC, fG, and fU=2'-F ribonucleosides; s=phosphorothioate, and wherein ademA-GalNAc=Chem. formula 5

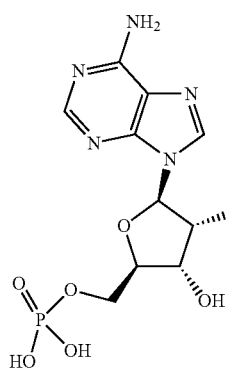
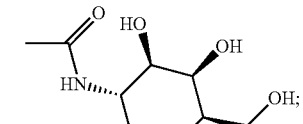

(iii) the sense strand comprises the sequence and all of the modifications of 5'-mAs-mG-mC-mA-mG-mC-mG-fU-fC-fC-fA-mC-mU-mC-mA-mG-mA-mG-mC-mA-mG-mC-mA-mG-mC-mC-mG-[ademA-GalNAc]-[ademA-GalNAc]-[ademA-GalNAc]-mG-mG-mC-mU-mG-mC-3' (SEQ ID NO: 1006), and wherein the antisense strand comprises the sequence and all of the modifications of 5'-[MePhosphonate-40-mUs]-fGs-fCs-fU-fC-mU-fG-mA-mG-fU-mG-mG-mA-fC-mG-mC-mU-mG-mC-mUs-mGs-mG-3' (SEQ ID NO: 1094), wherein mC, mA, mG, and mU=2'-OMe ribonucleosides; fA, fC, fG, and fU=2'-F ribonucleosides; s=phosphorothioate, and wherein ademA-GalNAc=Chem. formula 5

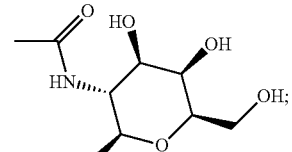
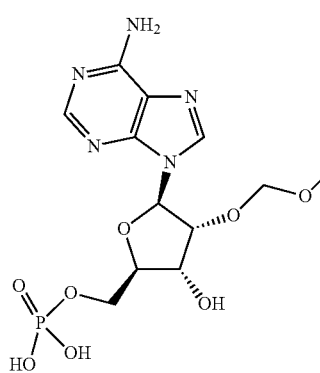

(iv) the sense strand comprises the sequence and all of the modifications of 5'-mAs-mU-mG-mU-mG-mC-mA-fC-fG-fA-fA-mU-mG-mA-mC-mU-mG-mU-mU-mA-mG-mC-mA-mG-mC-mC-mG-[ademA-GalNAc]-[ademA-GalNAc]-[ademA-GalNAc]-mG-mG-mC-mU-mG-mC-3' (SEQ ID NO: 1018), and wherein the antisense strand comprises the sequence and all of the modifications of 5'-[MePhosphonate-40-mUs]-fAs-fAs-fC-fA-mG-fU-mC-mA-fU-mU-mC-mG-fU-mG-mC-mA-mC-mA-mUs-mGs-mG-3' (SEQ ID NO: 1106), wherein mC, mA, mG, and mU=2'-OMe ribonucleosides; fA, fC, fG, and fU=2'-F ribonucleosides; s=phosphorothioate, and wherein ademA-GalNAc=Chem. formula 5

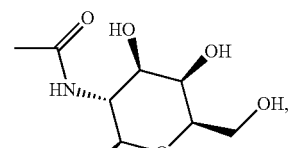
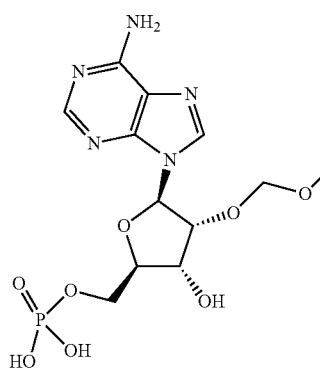

optionally wherein the oligonucleotide is a Dicer substrate.

In an aspect, the invention provides a pharmaceutical composition comprising the RNAi oligonucleotide according to the invention and a pharmaceutically acceptable carrier, delivery agent or excipient.

In an aspect, the invention provides a kit comprising the RNAi oligonucleotide according to the invention, an optional pharmaceutically acceptable carrier, and a package insert comprising instructions for administration to a subject having a disease, disorder or condition associated with NR1H3 expression, optionally for the treatment of non-alcoholic fatty liver disease (NAFLD), non-alcoholic steatohepatitis (NASH), or systemic lupus erythematosus In an aspect, the invention provides the use of the RNAi oligonucleotide according to the invention, or the pharmaceutical composition according to the invention, in the manufacture of a medicament for the treatment of a disease, disorder or condition associated with NR1H3 expression, optionally for the treatment of non-alcoholic fatty liver disease (NAFLD), non-alcoholic steatohepatitis (NASH), or systemic lupus erythematosus, optionally for use in in combination with a second composition or therapeutic agent.

DETAILED DESCRIPTION

Figure 1A:
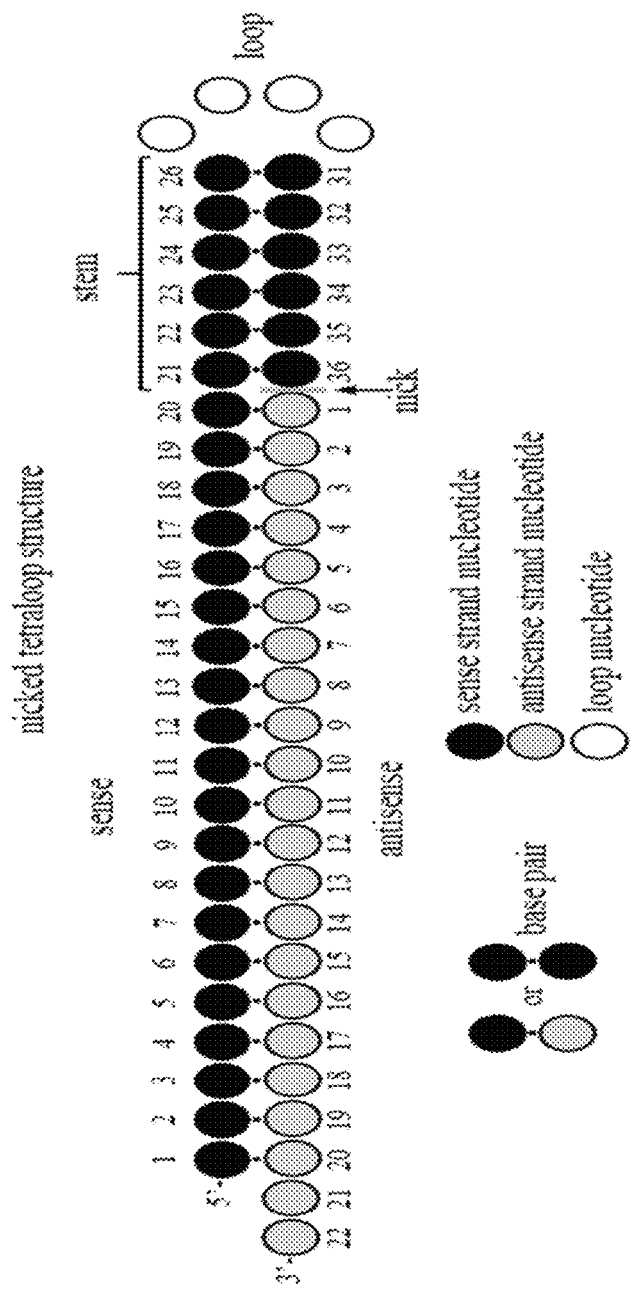
FIG. 1A provides a drawing of an oligonucleotide comprising a nicked tetraloop structure.

The liver X receptors α (LXRα; encoded by the NR1H3 gene) and β (LXRβ; encoded by NR1H2 gene) are nuclear receptors that function in the regulation of lipid and cholesterol homeostasis, as well as inflammation (Venkateswaran, A., et al., Proc. Natl. Acad. Sci. U.S.A, (2000); 97: 12097-102). LXRα is highly expressed in lipid metabolism-related organs such as the liver, small intestine, kidney, spleen, adrenal gland, and adipose tissue, whereas LXRβ expression is distributed ubiquitously. The hypothesis of specific inhibition of LXRα in the hepatocytes to treat NASH-related dyslipidemia is supported by several clinical and pre-clinical observations. Activation of LXRα increases plasma and hepatic TG and plasma LDLc, as was demonstrated in human subjects treated with LXR agonist in a dose-dependent manner (Kirchgessner, T. G., et al., Cell Metab, (2016); 24(2): 223-33). Consistent with this observation, hepatic deletion of LXRα in mice lowers liver fat and reduces plasma triglycerides. (J. Clin. Invest. (2012); 122(5): 1688-99.

In addition, hepatic expression of LXRα is significantly upregulated in liver biopsies from NAFLD and NASH patients (Ahn, S. B., et al. Dig. Dis. Sci. (2014); 59: 2975-82). However, avoiding inhibition of LXRα in macrophages is desirable as LXRα activation increases reverse cholesterol transport (RCT) which prevents atherosclerosis (Curr. Opin. Investig. Drugs. (2003); 4(9): 1053-8). Taken together, and without being bound by theory, antagonism/inhibition of LXRα specifically in hepatocytes (e.g., via NR1H3-targeted RNAi oligonucleotides) decreases de novo lipogenesis with concomitant preservation of LXRα function in macrophages and stellate cells for their positive roles in preventing inflammation and fibrosis respectively, thus representing a promising approach for treatment of NAFLD and/or NASH. (Higuchi, N., et al., Hepatol. Res. (2008); 38: 1122-29) (Repa, J. J.; and, Mangelsdorf, D. J. Annu. Rev. Cell Dev. Biol. (2000); 16: 459-81). This approach may be best managed by a specific and targeted reduction of the NR1H3 expression in the liver while other organs, tissues or cells expressing NR1H3 are left essentially alone. In this sense the current invention may provide an improved modality of treatment given its specific targeting of mRNA production in the liver.

According to some aspects, the disclosure provides oligonucleotides (e.g., RNAi oligonucleotides) that reduce NR1H3 expression in the liver. In some embodiments, the oligonucleotides provided herein are designed to treat diseases associated with NR1H3 expression in the liver, e.g., non-alcoholic fatty liver disease (NAFLD), or non-alcoholic steatohepatitis (NASH). In some respects, the disclosure provides methods of treating a disease associated with NR1H3 expression by reducing NR1H3 expression in cells (e.g., cells of the liver) or in organs (e.g., liver).

Oligonucleotide Inhibitors of NR1H3 Expression
NR1H3 Target Sequences

In some embodiments, an oligonucleotide herein (e.g., an RNAi oligonucleotide) is targeted to a target sequence comprising a NR1H3 mRNA. In some embodiments, an oligonucleotide described herein is targeted to a target sequence within a NR1H3 mRNA sequence. In some embodiments, the oligonucleotide described herein corresponds to a target sequence within a NR1H3 mRNA sequence. In some embodiments, the oligonucleotide, or a portion, fragment, or strand thereof (e.g., an antisense strand or a guide strand of a double-stranded (ds) RNAi oligonucleotide) binds or anneals to a target sequence comprising NR1H3 mRNA, thereby inhibiting NR1H3 expression.

In some embodiments, the oligonucleotide is targeted to a NR1H3 target sequence for the purpose of inhibiting NR1H3 expression in vivo. In some embodiments, the amount or extent of inhibition of NR1H3 expression by an oligonucleotide targeted to a NR1H3 target sequence correlates with the potency of the oligonucleotide. In some embodiments, the amount or extent of inhibition of NR1H3 expression by an oligonucleotide targeted to a NR1H3 target sequence correlates with the amount or extent of therapeutic benefit in a subject or patient having a disease, disorder or condition associated with NR1H3 expression treated with the oligonucleotide. Through examination of the nucleotide sequence of mRNAs encoding NR1H3, including mRNAs of multiple different species (e.g., human, cynomolgus monkey, mouse, and rat; see, e.g., Example 2) and as a result of in vitro and in vivo testing (see, e.g., Examples 2-5), it has been discovered that certain nucleotide sequences of NR1H3 mRNA are more amenable than others to oligonucleotide-based inhibition and are thus useful as target sequences for the oligonucleotides herein. In some embodiments, a sense strand of an oligonucleotide (e.g., an RNAi oligonucleotide) described herein comprises a NR1H3 target sequence. In some embodiments, a portion or region of the sense strand of an oligonucleotide described herein (e.g., an RNAi oligonucleotide) comprises a NR1H3 target sequence. In some embodiments, a NR1H3 target sequence comprises, or consists of, a sequence of any one of SEQ ID NOs: 1-384. In some embodiments, a NR1H3 target sequence can consist of one of the sequences set forth in SEQ ID NO: 92, 285, and/or 354.

NR1H3 Targeting Sequences

In some embodiments, the oligonucleotides herein (e.g., RNAi oligonucleotides) have regions of complementarity to NR1H3 mRNA (e.g., within a target sequence of NR1H3 mRNA) for purposes of targeting the NR1H3 mRNA in cells and inhibiting and/or reducing NR1H3 expression. In some embodiments, the oligonucleotides herein comprise a NR1H3 targeting sequence (e.g., an antisense strand or a guide strand of a dsRNAi oligonucleotide) having a region of complementarity that binds or anneals to a NR1H3 target sequence by complementary (Watson-Crick) base pairing. The targeting sequence or region of complementarity is generally of a suitable length and base content to enable binding or annealing of the oligonucleotide (or a strand thereof) to a NR1H3 mRNA for purposes of inhibiting and/or reducing NR1H3 expression. In some embodiments, the targeting sequence or region of complementarity is at least about 12, at least about 13, at least about 14, at least about 15, at least about 16, at least about 17, at least about 18, at least about 19, at least about 20, at least about 21, at least about 22, at least about 23, at least about 24, at least about 25, at least about 26, at least about 27, at least about 28, at least about 29, or at least about 30 nucleotides in length. In some embodiments, the targeting sequence or region of complementarity is about 12 to about 30 (e.g., 12 to 30, 12 to 22, 15 to 25, 17 to 21, 18 to 27, 19 to 27, or 15 to 30) nucleotides in length. In some embodiments, the targeting sequence or region of complementarity is about 12, 13, 14, 15, 16, 17, 18, 19, 20, 21, 22, 23, 24, 25, 26, 27, 28, 29, or 30 nucleotides in length. In some embodiments, the targeting sequence or region of complementarity is 18 nucleotides in length. In some embodiments, the targeting sequence or region of complementarity is 19 nucleotides in length. In some embodiments, the targeting sequence or region of complementarity is 20 nucleotides in length. In some embodiments, the targeting sequence or region of complementarity is 21 nucleotides in length. In some embodiments, the targeting sequence or region of complementarity is 22 nucleotides in length. In some embodiments, the targeting sequence or region of complementarity is 23 nucleotides in length. In some embodiments, the targeting sequence or region of complementarity is 24 nucleotides in length. In some embodiments, an oligonucleotide comprises a target sequence or region of complementarity complementary to a sequence of any one of SEQ ID NOs: 1-384. In some embodiments, an oligonucleotide comprises a target sequence or region of complementarity complementary to a sequence of any one of SEQ ID NOs: 1125-1511 and the targeting sequence or region of complementarity is 18 nucleotides in length. In some embodiments, an oligonucleotide comprises a target sequence or region of complementarity complementary to a sequence of any one of SEQ ID NOs: 1-384, and the targeting sequence or region of complementarity is 19 nucleotides in length. In some embodiments, an oligonucleotide comprises a target sequence or region of complementarity complementary to a sequence of any one of SEQ ID NOs: 1125-1511, and the targeting sequence or region of complementarity is 19 nucleotides in length.

In some embodiments, an oligonucleotide herein (e.g., an RNAi oligonucleotide) comprises a targeting sequence or a region of complementarity (e.g., an antisense strand or a guide strand of a double-stranded oligonucleotide) that is fully complementary to a NR1H3 target sequence. In some embodiments, the targeting sequence or region of complementarity is partially complementary to a NR1H3 target sequence. In some embodiments, the oligonucleotide comprises a targeting sequence or region of complementarity that is fully complementary to a NR1H3 target sequence. In some embodiments, the oligonucleotide comprises a targeting sequence or region of complementarity that is partially complementary to a NR1H3 target sequence.

In some embodiments, the oligonucleotide comprises a targeting sequence or region of complementarity that is fully complementary to a sequence of any one of SEQ ID NOs: 1-384. In some embodiments, the oligonucleotide comprises a targeting sequence or region of complementarity that is fully complementary to a sequence of any one of SEQ ID NOs: 1125-1511. In some embodiments, the oligonucleotide comprises a targeting sequence or region of complementarity that is fully complementary to the sequence set forth in SEQ ID NO: 1409, 1509, 1510 or 1511. In some embodiments, the oligonucleotide comprises a targeting sequence or region of complementarity that is partially complementary to a sequence of any one of SEQ ID NOs: 1-384. In some embodiments, the oligonucleotide comprises a targeting sequence or region of complementarity that is partially complementary to a sequence of any one of SEQ ID NOs: 1125-1511. In some embodiments, the oligonucleotide comprises a targeting sequence or region of complementarity that is partially complementary to the sequence set forth in SEQ ID NO: 1409, 1509, 1510 or 1511.

In some embodiments, an oligonucleotide herein (e.g., an RNAi oligonucleotide) comprises a targeting sequence or region of complementarity that is complementary to a contiguous sequence of nucleotides comprising a NR1H3 mRNA, wherein the contiguous sequence of nucleotides is about 12 to about 30 nucleotides in length (e.g., 12 to 30, 12 to 28, 12 to 26, 12 to 24, 12 to 20, 12 to 18, 12 to 16, 14 to 22, 16 to 20, 18 to 20, or 18 to 19 nucleotides in length). In some embodiments, the oligonucleotide comprises a targeting sequence or region of complementarity that is complementary to a contiguous sequence of nucleotides comprising a NR1H3 mRNA, wherein the contiguous sequence of nucleotides is 10, 11, 12, 13, 14, 15, 16, 17, 18, 19, or 20 nucleotides in length. In some embodiments, the oligonucleotide comprises a targeting sequence or region of complementarity that is complementary to a contiguous sequence of nucleotides comprising a NR1H3 mRNA, wherein the contiguous sequence of nucleotides is 19 nucleotides in length. In some embodiments, the oligonucleotide comprises a targeting sequence or region of complementarity that is complementary to a contiguous sequence of nucleotides comprising a NR1H3 mRNA, wherein the contiguous sequence of nucleotides is 20 nucleotides in length.

In some embodiments, an oligonucleotide herein (e.g., an RNAi oligonucleotide) comprises a targeting sequence or a region of complementary that is complementary to a contiguous sequence of nucleotides of any one of SEQ ID NOs: 1-384. In some embodiments, an oligonucleotide herein (e.g., an RNAi oligonucleotide) comprises a targeting sequence or a region of complementary that is complementary to a contiguous sequence of nucleotides of any one of SEQ ID NOs: 1125-1511, optionally wherein the contiguous sequence of nucleotides is 19 nucleotides in length. In some embodiments, the oligonucleotide comprises a targeting sequence or a region of complementary that is complementary to a contiguous sequence of nucleotides of any one of SEQ ID NOs:1409, 1509, 1510 or 1511, wherein the contiguous sequence of nucleotides is 19 nucleotides in length.

In some embodiments, a targeting sequence or region of complementarity of an oligonucleotide herein (e.g., an RNAi oligonucleotide) is complementary to a contiguous sequence of nucleotides of any one of SEQ ID NOs: 1-384. In some embodiments, a targeting sequence or region of complementarity of an oligonucleotide herein (e.g., an RNAi oligonucleotide) is complementary to a contiguous sequence of nucleotides of any one of SEQ ID NOs: 1125-1511. In some embodiments, a targeting sequence or region of complementarity of an oligonucleotide herein (e.g., an RNAi oligonucleotide) is complementary to a contiguous sequence of nucleotides of any one of SEQ ID NOs: 1-384 and spans the entire length of an antisense strand. In some embodiments, a targeting sequence or region of complementarity of the oligonucleotide is complementary to a contiguous sequence of nucleotides of SEQ ID NOs: 1-384 and spans a portion of the entire length of an antisense strand. In some embodiments, a targeting sequence or region of complementarity of the oligonucleotide is complementary to a contiguous sequence of nucleotides of SEQ ID NOs: 1125-1511 and spans a portion of the entire length of an antisense strand. In some embodiments, a targeting sequence or region of complementarity of the oligonucleotide is complementary to a contiguous sequence of nucleotides of SEQ ID NOs: 1125-1511 and spans a portion of the entire length of an antisense strand. In some embodiments, an oligonucleotide herein (e.g., an RNAi oligonucleotide) comprises a region of complementarity (e.g., on an antisense strand of a dsRNA) that is at least partially (e.g., fully) complementary to a contiguous stretch of nucleotides spanning nucleotides 1-19 or 1-20 of a sequence as set forth in any one of SEQ ID NOs: 1-384. In some embodiments, an oligonucleotide herein (e.g., an RNAi oligonucleotide) comprises a region of complementarity (e.g., on an antisense strand of a dsRNA) that is at least partially (e.g., fully) complementary to a contiguous stretch of nucleotides spanning nucleotides 1-19 or 1-20 of a sequence as set forth in any one of SEQ ID NOs: 1125-1511.

In some embodiments, an oligonucleotide herein (e.g., an RNAi oligonucleotide) comprises a targeting sequence or region of complementarity having one or more base pair (bp) mismatches with the corresponding NR1H3 target sequence. In some embodiments, the targeting sequence or region of complementarity may have up to about 1, up to about 2, up to about 3, up to about 4, up to about 5, etc. mismatches with the corresponding NR1H3 target sequence provided that the ability of the targeting sequence or region of complementarity to bind or anneal to the NR1H3 mRNA under appropriate hybridization conditions and/or the ability of the oligonucleotide to inhibit NR1H3 expression is maintained. Alternatively, the targeting sequence or region of complementarity may have no more than 1, no more than 2, no more than 3, no more than 4, or no more than 5 mismatches with the corresponding NR1H3 target sequence provided that the ability of the targeting sequence or region of complementarity to bind or anneal to the NR1H3 mRNA under appropriate hybridization conditions and/or the ability of the oligonucleotide to inhibit NR1H3 expression is maintained. In some embodiments, the oligonucleotide comprises a targeting sequence or region of complementarity having 1 mismatch with the corresponding target sequence. In some embodiments, the oligonucleotide comprises a targeting sequence or region of complementarity having 2 mismatches with the corresponding target sequence. In some embodiments, the oligonucleotide comprises a targeting sequence or region of complementarity having 3 mismatches with the corresponding target sequence. In some embodiments, the oligonucleotide comprises a targeting sequence or region of complementarity having 4 mismatches with the corresponding target sequence. In some embodiments, the oligonucleotide comprises a targeting sequence or region of complementarity having 5 mismatches with the corresponding target sequence. In some embodiments, the oligonucleotide comprises a targeting sequence or region of complementarity having more than one mismatch (e.g., 2, 3, 4, 5 or more mismatches) with the corresponding target sequence, wherein at least 2 (e.g., all) of the mismatches are positioned consecutively (e.g., 2, 3, 4, 5 or more mismatches in a row), or wherein the mismatches are interspersed throughout the targeting sequence or region of complementarity. In some embodiments, the oligonucleotide comprises a targeting sequence or region of complementarity having more than one mismatch (e.g., 2, 3, 4, 5 or more mismatches) with the corresponding target sequence, wherein at least 2 (e.g., all) of the mismatches are positioned consecutively (e.g., 2, 3, 4, 5 or more mismatches in a row), or wherein at least one or more non-mismatched base pair is located between the mismatches, or a combination thereof. In some embodiments, the oligonucleotide comprises a targeting sequence or a region of complementary that is complementary to a contiguous sequence of nucleotides of any one of SEQ ID NOs: 1-384, wherein the targeting sequence or region of complementarity may have up to about 1, up to about 2, up to about 3, up to about 4, up to about 5, etc. mismatches with the corresponding NR1H3 target sequence. In some embodiments, the oligonucleotide comprises a targeting sequence or a region of complementary that is complementary to a contiguous sequence of nucleotides of any one of SEQ ID NOs: 1125-1511, wherein the targeting sequence or region of complementarity may have up to about 1, up to about 2, up to about 3, up to about 4, up to about 5, etc. mismatches with the corresponding NR1H3 target sequence. In some embodiments, the oligonucleotide comprises a targeting sequence or a region of complementary that is complementary to a contiguous sequence of nucleotides of any one of SEQ ID NOs: 1-384, wherein the targeting sequence or region of complementarity may have no more than 1, no more than 2, no more than 3, no more than 4, or no more than 5 mismatches with the corresponding NR1H3 target sequence. In some embodiments, the oligonucleotide comprises a targeting sequence or a region of complementary that is complementary to a contiguous sequence of nucleotides of any one of SEQ ID NOs: 1125-1511, wherein the targeting sequence or region of complementarity may have no more than 1, no more than 2, no more than 3, no more than 4, or no more than 5 mismatches with the corresponding NR1H3 target sequence. In some embodiments, the oligonucleotide comprises a targeting sequence or a region of complementary that is complementary to a contiguous sequence of nucleotides of any one of SEQ ID NOs:1409, 1509, 1510 or 1511, wherein the targeting sequence or region of complementarity may have up to about 1, up to about 2, up to about 3, up to about 4, up to about 5, etc. mismatches with the corresponding NR1H3 target sequence. In some embodiments, the oligonucleotide comprises a targeting sequence or a region of complementary that is complementary to a contiguous sequence of nucleotides of any one of SEQ ID NOs: 1409, 1509, 1510 or 1511, wherein the targeting sequence or region of complementarity may have no more than 1, no more than 2, no more than 3, no more than 4, or no more than 5 mismatches with the corresponding NR1H3 target sequence.

Types of Oligonucleotides

A variety of oligonucleotide types and/or structures are useful for targeting NR1H3 in the methods herein including, but not limited to, RNAi oligonucleotides, antisense oligonucleotides (ASOs), miRNAs, etc. Any of the oligonucleotide types described herein or elsewhere are contemplated for use as a framework to incorporate a NR1H3 targeting sequence herein for the purposes of inhibiting NR1H3 expression.

In some embodiments, the oligonucleotides herein inhibit NR1H3 expression by engaging with RNA interference (RNAi) pathways upstream or downstream of Dicer involvement. For example, RNAi oligonucleotides have been developed with each strand having sizes of about 19-25 nucleotides with at least one 3'-overhang of 1 to 5 nucleotides (see, e.g., U.S. Pat. No. 8,372,968). Longer oligonucleotides also have been developed that are processed by Dicer to generate active RNAi products (see, e.g., U.S. Pat. No. 8,883,996). Further work produced extended dsRNAs where at least one end of at least one strand is extended beyond a duplex targeting region, including structures where one of the strands includes a thermodynamically stabilizing tetraloop structure (see, e.g., U.S. Pat. Nos. 8,513,207 and 8,927,705, as well as Intl. Patent Application Publication No. WO 2010/033225). Such structures may include single-stranded (ss) extensions (on one or both sides of the molecule) as well as double-stranded (ds) extensions.

In some embodiments, the oligonucleotides herein engage with the RNAi pathway downstream of the involvement of Dicer (e.g., Dicer cleavage). In some embodiments, the oligonucleotides described herein are Dicer substrates. In some embodiments, upon endogenous Dicer processing, double-stranded nucleic acids of 19-23 nucleotides in length capable of reducing NR1H3 expression are produced. In some embodiments, the oligonucleotide has an overhang (e.g., of 1, 2, or 3 nucleotides in length) in the 3' end of the sense strand. In some embodiments, the oligonucleotide (e.g., siRNA) comprises a 21-nucleotide guide strand that is antisense to a target RNA and a complementary passenger strand, in which both strands anneal to form a 19-bp duplex and 2 nucleotide overhangs at either or both 3' ends. Longer oligonucleotide designs also are available including oligonucleotides having a guide strand of 23 nucleotides and a passenger strand of 21 nucleotides, where there is a blunt end on the right side of the molecule (3' end of passenger strand/5' end of guide strand) and a two nucleotide 3'-guide strand overhang on the left side of the molecule (5' end of the passenger strand/3' end of the guide strand). In such molecules, there is a 21 bp duplex region. See, e.g., U.S. Pat. Nos. 9,012,138; 9,012,621 and 9,193,753.

In some embodiments, the oligonucleotides herein comprise sense and antisense strands that are both in the range of about 17 to 36 (e.g., 17 to 36, 20 to 25, or 21-23) nucleotides in length. In some embodiments, the oligonucleotides described herein comprise an antisense strand of 19-30 nucleotides in length and a sense strand of 19-50 nucleotides in length, wherein the antisense and sense strands are separate strands which form an asymmetric duplex region having an overhang of 1-4 nucleotides at the 3' terminus of the antisense strand. In some embodiments, an oligonucleotide herein comprises a sense and antisense strand that are both in the range of about 19-22 nucleotides in length. In some embodiments, the sense and antisense strands are of equal length. In some embodiments, an oligonucleotide comprises sense and antisense strands, such that there is a 3'-overhang on either the sense strand or the antisense strand, or both the sense and antisense strand. In some embodiments, for oligonucleotides that have sense and antisense strands that are both in the range of about 21-23 nucleotides in length, a 3'-overhang on the sense, antisense, or both sense and antisense strands is 1 or 2 nucleotides in length. In some embodiments, the oligonucleotide has a guide strand of 22 nucleotides and a passenger strand of 20 nucleotides, where there is a blunt end on the right side of the molecule (3' end of passenger strand/5' end of guide strand) and a 2 nucleotide 3'-guide strand overhang on the left side of the molecule (5' end of the passenger strand/3' end of the guide strand). In such molecules, there is a 20 bp duplex region.

Other oligonucleotide designs for use with the compositions and methods herein include: 16-mer siRNAs (see, e.g., NUCLEIC ACIDS IN CHEMISTRY AND BIOLOGY. Blackburn (ed.), Royal Society of Chemistry, 2006), shRNAs (e.g., having 19 bp or shorter stems; see, e.g., Moore et al. METHODS MOL. BIOL. (2010); 629: 141-158), blunt siRNAs (e.g., of 19 bps in length; see, e.g., Kraynack & Baker RNA (2006); 12: 163-176), asymmetrical siRNAs (aiRNA; see, e.g., Sun et al. NAT. BIOTECHNOL. (2008); 26: 1379-1382), asymmetric shorter-duplex siRNA (see, e.g., Chang et al. MOL. THER. (2009); 17: 725-32), fork siRNAs (see, e.g., Hohjoh FEBS LETT. (2004); 557: 193-198), ss siRNAs (Elsner NAT. BIOTECHNOL. (2012); 30: 1063), dumbbell-shaped circular siRNAs (see, e.g., Abe et al. J. AM. CHEM. SOC. (2007); 129: 15108-09), and small internally segmented interfering RNA (siRNA; see, e.g., Bramsen et al. NUCLEIC ACIDS RES. (2007); 35: 5886-97). Further non-limiting examples of an oligonucleotide structures that may be used in some embodiments to reduce or inhibit the expression of NR1H3 are microRNA (miRNA), short hairpin RNA (shRNA) and short siRNA (see, e.g., Hamilton et al. EMBO J. (2002); 21: 4671-79; see also, US Patent Application Publication No. 2009/0099115).

Still, in some embodiments, an oligonucleotide for reducing or inhibiting NR1H3 expression herein is single-stranded (ss). Such structures may include but are not limited to single-stranded RNAi molecules. Recent efforts have demonstrated the activity of ss RNAi molecules (see, e.g., Matsui et al. MOL. THER. (2016); 24: 946-55). However, in some embodiments, oligonucleotides herein are antisense oligonucleotides (ASOs). An antisense oligonucleotide is a single-stranded oligonucleotide that has a nucleobase sequence which, when written in the 5' to 3' direction, comprises the reverse complement of a targeted segment of a particular nucleic acid and is suitably modified (e.g., as a gapmer) so as to induce RNaseH-mediated cleavage of its target RNA in cells or (e.g., as a mixmer) so as to inhibit translation of the target mRNA in cells. ASOs for use herein may be modified in any suitable manner known in the art including, for example, as shown in U.S. Pat. No. 9,567,587 (including, e.g., length, sugar moieties of the nucleobase (pyrimidine, purine), and alterations of the heterocyclic portion of the nucleobase). Further, ASOs have been used for decades to reduce expression of specific target genes (see, e.g., Bennett et al. ANNU. REV. PHARMACOL. (2017); 57: 81-105).

In some embodiments, the antisense oligonucleotide shares a region of complementarity with NR1H3 mRNA. In some embodiments, the antisense oligonucleotide targets the human NR1H3 mRNA (*Homo sapiens* NR1H3, mRNA, transcript variant 5, NCBI Reference Sequence: NM_001251935.1). In some embodiments, the antisense oligonucleotide is 15-50 nucleotides in length. In some embodiments, the antisense oligonucleotide is 15-25 nucleotides in length. In some embodiments, the antisense oligonucleotide is 22 nucleotides in length. In some embodiments, the antisense oligonucleotide is complementary to any one of SEQ ID NOs: 1-384. In some embodiments, the antisense oligonucleotide is complementary to any one of SEQ ID NOs: 1125-1511. In some embodiments, the antisense oligonucleotide is at least 15 contiguous nucleotides in length. In some embodiments, the antisense oligonucleotide is at least 19 contiguous nucleotides in length. In some embodiments, the antisense oligonucleotide is at least 20 contiguous nucleotides in length. In some embodiments, the antisense oligonucleotide differs by 1, 2, or 3 nucleotides from the target sequence.

Double-Stranded Oligonucleotides

In some aspects, the disclosure provides double-stranded (ds) RNAi oligonucleotides for targeting NR1H3 mRNA and inhibiting NR1H3 expression (e.g., via the RNAi pathway) comprising a sense strand (also referred to herein as a passenger strand) and an antisense strand (also referred to herein as a guide strand). In some embodiments, the sense strand and antisense strand are separate strands and are not covalently linked. In some embodiments, the sense strand and antisense strand are covalently linked. In some embodiments, the sense strand and antisense strand form a duplex region, wherein the sense strand and antisense strand, or a portion thereof, binds with one another in a complementary fashion (e.g., by Watson-Crick base pairing).

In some embodiments, the sense strand has a first region (R1) and a second region (R2), wherein R2 comprises a first subregion (S1), a tetraloop (L) or triloop (triL), and a second subregion (S2), wherein L or triL is located between S1 and S2, and wherein S1 and S2 form a second duplex (D2). D2 may have various length. In some embodiments, D2 is about 1-6 bp in length. In some embodiments, D2 is 2-6, 3-6, 4-6, 5-6, 1-5, 2-5, 3-5, or 4-5 bp in length. In some embodiments, D2 is 1, 2, 3, 4, 5, or 6 bp in length. In some embodiments, D2 is 6 bp in length. In some embodiments, R1 of the sense strand and the antisense strand form a first duplex (D1). In some embodiments, D1 is at least about 15 (e.g., at least 15, at least 16, at least 17, at least 18, at least 19, at least 20, or at least 21) nucleotides in length. In some embodiments, D1 is in the range of about 12 to 30 nucleotides in length (e.g., 12 to 30, 12 to 27, 15 to 22, 18 to 22, 18 to 25, 18 to 27, 18 to 30, or 21 to 30 nucleotides in length). In some embodiments, D1 is at least 12 nucleotides in length (e.g., at least 12, at least 15, at least 20, at least 25, or at least 30 nucleotides in length). In some embodiments, D1 is 12, 13, 14, 15, 16, 17, 18, 19, 20, 21, 22, 23, 24, 25, 26, 27, 28, 29, or 30 nucleotides in length. In some embodiments, D1 is 20 nucleotides in length. In some embodiments, D1 comprising sense strand and antisense strand does not span the entire length of the sense strand and/or antisense strand. In some embodiments, D1 comprising the sense strand and antisense strand spans the entire length of either the sense strand or antisense strand or both. In certain embodiments, D1 comprising the sense strand and antisense strand spans the entire length of both the sense strand and the antisense strand.

In some embodiments, an oligonucleotide provided herein comprises a sense strand having a sequence of any one of SEQ ID NOs: 1-384 and an antisense strand comprising a complementary sequence selected from SEQ ID NOs: 385-768. In some embodiments, an oligonucleotide provided herein comprises a sense strand having a sequence of any one of SEQ ID NOs: 1125-1511 and an antisense strand comprising a complementary sequence selected from SEQ ID NOs: 1512-1515.

In some embodiments, an oligonucleotide provided herein (e.g., an RNAi oligonucleotide) comprises a sense strand having a sequence of any one of SEQ ID NOs: 769-856 or 1519-1552 and an antisense strand comprising a complementary sequence selected from SEQ ID NOs: 857-944 as is arranged in Tables 3 and 4.

In some embodiments, an oligonucleotide provided herein (e.g., an RNAi oligonucleotide) comprises a sense strand and an antisense strand comprising nucleotide sequences selected from:

(a) SEQ ID NOs: 769 and 857, respectively;
(b) SEQ ID NOs: 770 and 858, respectively;
(c) SEQ ID NOs: 771 and 859, respectively;
(d) SEQ ID NOs: 772 and 860, respectively;
(e) SEQ ID NOs: 773 and 861, respectively;
(f) SEQ ID NOs: 774 and 862, respectively;
(g) SEQ ID NOs: 775 and 863, respectively;
(h) SEQ ID NOs: 776 and 864, respectively;
(i) SEQ ID NOs: 777 and 865, respectively;
(j) SEQ ID NOs: 778 and 866, respectively;
(k) SEQ ID NOs: 779 and 867, respectively;
(l) SEQ ID NOs: 780 and 868, respectively;
(m) SEQ ID NOs: 781 and 869, respectively;
(n) SEQ ID NOs: 782 and 870, respectively;
(o) SEQ ID NOs: 783 and 871, respectively;
(p) SEQ ID NOs: 784 and 872, respectively;
(q) SEQ ID NOs: 785 and 873, respectively;
(r) SEQ ID NOs: 786 and 874, respectively;
(s) SEQ ID NOs: 787 and 875, respectively;
(t) SEQ ID NOs: 788 and 876, respectively;
(u) SEQ ID NOs: 789 and 877, respectively;

(v) SEQ ID NOs: 790 and 878, respectively;
(w) SEQ ID NOs: 791 and 879, respectively;
(x) SEQ ID NOs: 792 and 880, respectively;
(y) SEQ ID NOs: 793 and 881, respectively;
(z) SEQ ID NOs: 794 and 882, respectively;
(aa) SEQ ID NOs: 795 and 883, respectively;
(bb) SEQ ID NOs: 796 and 884, respectively;
(cc) SEQ ID NOs: 797 and 885, respectively;
(dd) SEQ ID NOs: 798 and 886, respectively;
(ee) SEQ ID NOs: 799 and 887, respectively;
(ff) SEQ ID NOs: 800 and 888, respectively;
(gg) SEQ ID NOs: 801 and 889, respectively;
(hh) SEQ ID NOs: 802 and 890, respectively;
(ii) SEQ ID NOs: 803 and 891, respectively;
(jj) SEQ ID NOs: 804 and 892, respectively;
(kk) SEQ ID NOs: 805 and 893, respectively;
(ll) SEQ ID NOs: 806 and 894, respectively;
(mm) SEQ ID NOs: 807 and 895, respectively;
(nn) SEQ ID NOs: 808 and 896, respectively;
(oo) SEQ ID NOs: 809 and 897, respectively;
(pp) SEQ ID NOs: 810 and 898, respectively;
(qq) SEQ ID NOs: 811 and 899, respectively;
(rr) SEQ ID NOs: 812 and 900, respectively;
(ss) SEQ ID NOs: 813 and 901, respectively;
(tt) SEQ ID NOs: 814 and 902, respectively;
(uu) SEQ ID NOs: 815 and 903, respectively;
(vv) SEQ ID NOs: 816 and 904, respectively;
(ww) SEQ ID NOs: 817 and 905, respectively;
(xx) SEQ ID NOs: 818 and 906, respectively;
(yy) SEQ ID NOs: 819 and 907, respectively;
(zz) SEQ ID NOs: 820 and 908, respectively;
(aaa) SEQ ID NOs: 821 and 909, respectively;
(bbb) SEQ ID NOs: 822 and 910, respectively;
(ccc) SEQ ID NOs: 823 and 911, respectively;
(ddd) SEQ ID NOs: 824 and 912, respectively;
(eee) SEQ ID NOs: 825 and 913, respectively;
(fff) SEQ ID NOs: 826 and 914, respectively;
(ggg) SEQ ID NOs: 827 and 915, respectively;
(hhh) SEQ ID NOs: 828 and 916, respectively;
(iii) SEQ ID NOs: 829 and 917, respectively;
(jjj) SEQ ID NOs: 830 and 918, respectively;
(kkk) SEQ ID NOs: 831 and 919, respectively;
(lll) SEQ ID NOs: 832 and 920, respectively;
(mmm) SEQ ID NOs: 833 and 921, respectively;
(nnn) SEQ ID NOs: 834 and 922, respectively;
(ooo) SEQ ID NOs: 835 and 923, respectively;
(ppp) SEQ ID NOs: 836 and 924, respectively;
(qqq) SEQ ID NOs: 837 and 925, respectively;
(rrr) SEQ ID NOs: 838 and 926, respectively;
(sss) SEQ ID NOs: 839 and 927, respectively;
(ttt) SEQ ID NOs: 840 and 928, respectively;
(uuu) SEQ ID NOs: 1537 and 929, respectively;
(vvv) SEQ ID NOs: 842 and 930, respectively;
(www) SEQ ID NOs: 843 and 931, respectively;
(xxx) SEQ ID NOs: 844 and 932, respectively;
(yyy) SEQ ID NOs: 845 and 933, respectively;
(zzz) SEQ ID NOs: 846 and 934, respectively;
(aaaa) SEQ ID NOs: 847 and 935, respectively;
(bbbb) SEQ ID NOs: 848 and 936, respectively;
(cccc) SEQ ID NOs: 849 and 937, respectively;
(dddd) SEQ ID NOs: 850 and 938, respectively;
(eeee) SEQ ID NOs: 851 and 939, respectively;
(ffff) SEQ ID NOs: 852 and 940, respectively;
(gggg) SEQ ID NOs: 853 and 941, respectively;
(hhhh) SEQ ID NOs: 854 and 942, respectively;
(iiii) SEQ ID NOs: 855 and 943, respectively; and,
(jjjj) SEQ ID NOs: 856 and 944, respectively.

In some embodiments, an oligonucleotide provided herein (e.g., an RNAi oligonucleotide) comprises a sense strand and an antisense strand comprising nucleotide sequences selected from:
(a) SEQ ID NOs: 786 and 874, respectively;
(b) SEQ ID NOs: 787 and 875, respectively;
(c) SEQ ID NOs: 1537 and 929, respectively; and,
(d) SEQ ID NOs: 813 and 901, respectively.

In some embodiments, the sense strand comprises the sequence of SEQ ID NO: 786 and the antisense strand comprises the sequence of SEQ ID NO: 874.

In some embodiments, the sense strand comprises the sequence of SEQ ID NO: 787 and the antisense strand comprises the sequence of SEQ ID NO: 875.

In some embodiments, the sense strand comprises the sequence of SEQ ID NO: 1537 and the antisense strand comprises the sequence of SEQ ID NO: 929.

In some embodiments, the sense strand comprises the sequence of SEQ ID NO: 813 and the antisense strand comprises the sequence of SEQ ID NO: 901.

It should be appreciated that, in some embodiments, sequences presented in the Sequence Listing may be referred to in describing the structure of an oligonucleotide (e.g., a dsRNAi oligonucleotide) or other nucleic acid. In such embodiments, the actual oligonucleotide or other nucleic acid may have one or more alternative nucleotides (e.g., an RNA counterpart of a DNA nucleotide or a DNA counterpart of an RNA nucleotide) and/or one or more modified nucleotides and/or one or more modified internucleotide linkages and/or one or more other modification when compared with the specified sequence while retaining essentially same or similar complementary properties as the specified sequence.

In some embodiments, an oligonucleotide herein (e.g., an RNAi oligonucleotide) comprises a 25-nucleotide sense strand and a 27-nucleotide antisense strand that when acted upon by a Dicer enzyme results in an antisense strand that is incorporated into the mature RISC. In some embodiments, the 25-nucleotide sense strand comprises a sequence selected from SEQ ID NOs: 1-384. In some embodiments, the 27-nucleotide antisense strand comprises a sequence selected from SEQ ID NOs: 385-768. In some embodiments, the sense strand of the oligonucleotide is longer than 27 nucleotides (e.g., 28, 29, 30, 31, 32, 33, 34, 35, 36, 37, 38, 39, 40, 41, 42, 43, 44, 45, 46, 47, 48, 49, or 50 nucleotides). In some embodiments, the sense strand of the oligonucleotide is longer than 25 nucleotides (e.g., 26, 27, 28, 29, or 30 nucleotides). In some embodiments, the sense strand of the oligonucleotide comprises a nucleotide sequence selected from SEQ ID NOs: 769-856, wherein the nucleotide sequence is longer than 27 nucleotides (e.g., 28, 29, 30, 31, 32, 33, 34, 35, 36, 37, 38, 39, 40, 41, 42, 43, 44, 45, 46, 47, 48, 49, or 50 nucleotides).). In some embodiments, the sense strand of the oligonucleotide comprises a nucleotide sequence selected from SEQ ID NOs: 1519-1552, wherein the nucleotide sequence is longer than 27 nucleotides (e.g., 28, 29, 30, 31, 32, 33, 34, 35, 36, 37, 38, 39, 40, 41, 42, 43, 44, 45, 46, 47, 48, 49, or 50 nucleotides). In some embodiments, the sense strand of the oligonucleotide comprises a nucleotide sequence selected from SEQ ID NOs: 769-856, wherein the nucleotide sequence is longer than 25 nucleotides (e.g., 26, 27, 28, 29 or 30 nucleotides).

In some embodiments, oligonucleotides herein (e.g., RNAi oligonucleotides) have one 5' end that is thermodynamically less stable when compared to the other 5' end. In some embodiments, an asymmetric oligonucleotide is provided that includes a blunt end at the 3' end of a sense strand and a 3'-overhang at the 3' end of an antisense strand. In some embodiments, the 3'-overhang on the antisense strand is about 1-8 nucleotides in length (e.g., 1, 2, 3, 4, 5, 6, 7, or 8 nucleotides in length). In some embodiments, the oligonucleotide has an overhang comprising two (2) nucleotides on the 3' end of the antisense (guide) strand. However, other overhangs are possible. In some embodiments, an overhang is a 3'-overhang comprising a length of between 1 and 6 nucleotides, optionally 1 to 5, 1 to 4, 1 to 3, 1 to 2, 2 to 6, 2 to 5, 2 to 4, 2 to 3, 3 to 6, 3 to 5, 3 to 4, 4 to 6, 4 to 5, 5 to 6 nucleotides, or 1, 2, 3, 4, 5, or 6 nucleotides. However, in some embodiments, the overhang is a 5'-overhang comprising a length of between 1 and 6 nucleotides, optionally 1 to 5, 1 to 4, 1 to 3, 1 to 2, 2 to 6, 2 to 5, 2 to 4, 2 to 3, 3 to 6, 3 to 5, 3 to 4, 4 to 6, 4 to 5, 5 to 6 nucleotides, or 1, 2, 3, 4, 5, or 6 nucleotides. In some embodiments, the oligonucleotide comprises a targeting sequence or a region of complementary that is complementary to a contiguous sequence of nucleotides of any one of SEQ ID NOs: 1-384, and a 5'-overhang comprising a length of between 1 and 6 nucleotides. In some embodiments, the oligonucleotide comprises a targeting sequence or a region of complementary that is complementary to a contiguous sequence of nucleotides of any one of SEQ ID NOs: 1125-1511, and a 5'-overhang comprising a length of between 1 and 6 nucleotides. In some embodiments, the oligonucleotide comprises a sense strand comprising a nucleotide sequence selected from SEQ ID NOs: 769-856, wherein the oligonucleotide comprises a 5'-overhang comprising a length of between 1 and 6 nucleotides. In some embodiments, the oligonucleotide comprises a sense strand comprising a nucleotide sequence selected from SEQ ID NOs: 1519-1552, wherein the oligonucleotide comprises a 5'-overhang comprising a length of between 1 and 6 nucleotides. In some embodiments, the oligonucleotide comprises an antisense strand comprising a nucleotide sequence selected from SEQ ID NOs: 857-944, wherein the oligonucleotide comprises a 5'-overhang comprising a length of between 1 and 6 nucleotides. In some embodiments, the oligonucleotide comprises a sense strand comprising a nucleotide sequence selected from SEQ ID NOs: 769-856 and antisense strand comprising a nucleotide sequence selected from SEQ ID NOs: 857-944, wherein the oligonucleotide comprises a 5'-overhang comprising a length of between 1 and 6 nucleotides. In some embodiments, the oligonucleotide comprises a sense strand comprising a nucleotide sequence selected from SEQ ID NOs: 1519-1552 and antisense strand comprising a nucleotide sequence selected from SEQ ID NOs: 857-944, wherein the oligonucleotide comprises a 5'-overhang comprising a length of between 1 and 6 nucleotides.

In some embodiments, two (2) terminal nucleotides on the 3' end of an antisense strand are modified. In some embodiments, the two (2) terminal nucleotides on the 3' end of the antisense strand are complementary with the target mRNA (e.g., NR1H3 mRNA). In some embodiments, the two (2) terminal nucleotides on the 3' end of the antisense strand are not complementary with the target mRNA. In some embodiments, the two (2) terminal nucleotides on the 3' end of the antisense strand of an oligonucleotide herein are unpaired. In some embodiments, the two (2) terminal nucleotides on the 3' end of the antisense strand of an oligonucleotide herein comprise an unpaired GG. In some embodiments, the two (2) terminal nucleotides on the 3' end of an antisense strand of an oligonucleotide herein are not complementary to the target mRNA. In some embodiments, two (2) terminal nucleotides on each 3' end of an oligonucleotide are GG. In some embodiments, one or both of the two (2) terminal GG nucleotides on each 3' end of an oligonucleotide herein is not complementary with the target mRNA. In some embodiments, the oligonucleotide comprises a targeting sequence or a region of complementary that is complementary to a contiguous sequence of nucleotides of any one of SEQ ID NOs: 1-384, wherein the two (2) terminal nucleotides on the 3' end of the antisense strand of the oligonucleotide herein comprises an unpaired GG. In some embodiments, the oligonucleotide comprises a targeting sequence or a region of complementary that is complementary to a contiguous sequence of nucleotides of any one of SEQ ID NOs: 1125-1511, wherein the two (2) terminal nucleotides on the 3' end of the antisense strand of the oligonucleotide herein comprises an unpaired GG. In some embodiments, the oligonucleotide comprises an antisense strand comprising a nucleotide sequence selected from SEQ ID NOs: 857-944, wherein the two (2) terminal nucleotides on the 3' end of the antisense strand of the oligonucleotide comprises an unpaired GG. In some embodiments, the oligonucleotide comprises a sense strand comprising a nucleotide sequence selected from SEQ ID NOs: 769-856 and antisense strand comprising a nucleotide sequence selected from SEQ ID NOs: 857-944, wherein the two (2) terminal nucleotides on the 3' end of the antisense strand of the oligonucleotide comprises an unpaired GG. In some embodiments, the oligonucleotide comprises a sense strand comprising a nucleotide sequence selected from SEQ ID NOs: 1519-1552 and antisense strand comprising a nucleotide sequence selected from SEQ ID NOs: 857-944, wherein the two (2) terminal nucleotides on the 3' end of the antisense strand of the oligonucleotide comprises an unpaired GG.

In some embodiments, there is one or more (e.g., 1, 2, 3, 4, or 5) mismatch(es) between a sense and antisense strand comprising an oligonucleotide herein (e.g., an RNAi oligonucleotide). If there is more than one mismatch between a sense and antisense strand, they may be positioned consecutively (e.g., 2, 3 or more in a row), or interspersed throughout the region of complementarity. In some embodiments, the 3' end of the sense strand comprises one or more mismatches. In some embodiments, two (2) mismatches are incorporated at the 3' end of the sense strand. In some embodiments, base mismatches, or destabilization of segments at the 3' end of the sense strand of an oligonucleotide herein improves or increases the potency of the oligonucleotide. In some embodiments, the sense and antisense strands of an oligonucleotide herein comprise nucleotides sequences selected from the group consisting of:

(a) SEQ ID NOs: 769 and 857, respectively;
(b) SEQ ID NOs: 770 and 858, respectively;
(c) SEQ ID NOs: 771 and 859, respectively;
(d) SEQ ID NOs: 772 and 860, respectively;
(e) SEQ ID NOs: 773 and 861, respectively;
(f) SEQ ID NOs: 774 and 862, respectively;
(g) SEQ ID NOs: 775 and 863, respectively;
(h) SEQ ID NOs: 776 and 864, respectively;
(i) SEQ ID NOs: 777 and 865, respectively;
(j) SEQ ID NOs: 778 and 866, respectively;
(k) SEQ ID NOs: 779 and 867, respectively;
(l) SEQ ID NOs: 780 and 868, respectively;
(m) SEQ ID NOs: 781 and 869, respectively;
(n) SEQ ID NOs: 782 and 870, respectively;
(o) SEQ ID NOs: 783 and 871, respectively;
(p) SEQ ID NOs: 784 and 872, respectively;
(q) SEQ ID NOs: 785 and 873, respectively;
(r) SEQ ID NOs: 786 and 874, respectively;
(s) SEQ ID NOs: 787 and 875, respectively;
(t) SEQ ID NOs: 788 and 876, respectively;
(u) SEQ ID NOs: 789 and 877, respectively;

(v) SEQ ID NOs: 790 and 878, respectively;
(w) SEQ ID NOs: 791 and 879, respectively;
(x) SEQ ID NOs: 792 and 880, respectively;
(y) SEQ ID NOs: 793 and 881, respectively;
(z) SEQ ID NOs: 794 and 882, respectively;
(aa) SEQ ID NOs: 795 and 883, respectively;
(bb) SEQ ID NOs: 796 and 884, respectively;
(cc) SEQ ID NOs: 797 and 885, respectively;
(dd) SEQ ID NOs: 798 and 886, respectively;
(ee) SEQ ID NOs: 799 and 887, respectively;
(ff) SEQ ID NOs: 800 and 888, respectively;
(gg) SEQ ID NOs: 801 and 889, respectively;
(hh) SEQ ID NOs: 802 and 890, respectively;
(ii) SEQ ID NOs: 803 and 891, respectively;
(jj) SEQ ID NOs: 804 and 892, respectively;
(kk) SEQ ID NOs: 805 and 893, respectively;
(ll) SEQ ID NOs: 806 and 894, respectively;
(mm) SEQ ID NOs: 807 and 895, respectively;
(nn) SEQ ID NOs: 808 and 896, respectively;
(oo) SEQ ID NOs: 809 and 897, respectively;
(pp) SEQ ID NOs: 810 and 898, respectively;
(qq) SEQ ID NOs: 811 and 899, respectively;
(rr) SEQ ID NOs: 812 and 900, respectively;
(ss) SEQ ID NOs: 813 and 901, respectively;
(tt) SEQ ID NOs: 814 and 902, respectively;
(uu) SEQ ID NOs: 815 and 903, respectively;
(vv) SEQ ID NOs: 816 and 904, respectively;
(ww) SEQ ID NOs: 817 and 905, respectively;
(xx) SEQ ID NOs: 818 and 906, respectively;
(yy) SEQ ID NOs: 819 and 907, respectively;
(zz) SEQ ID NOs: 820 and 908, respectively;
(aaa) SEQ ID NOs: 821 and 909, respectively;
(bbb) SEQ ID NOs: 822 and 910, respectively;
(ccc) SEQ ID NOs: 823 and 911, respectively;
(ddd) SEQ ID NOs: 824 and 912, respectively;
(eee) SEQ ID NOs: 825 and 913, respectively;
(fff) SEQ ID NOs: 826 and 914, respectively;
(ggg) SEQ ID NOs: 827 and 915, respectively;
(hhh) SEQ ID NOs: 828 and 916, respectively;
(iii) SEQ ID NOs: 829 and 917, respectively;
(jjj) SEQ ID NOs: 830 and 918, respectively;
(kkk) SEQ ID NOs: 831 and 919, respectively;
(lll) SEQ ID NOs: 832 and 920, respectively;
(mmm) SEQ ID NOs: 833 and 921, respectively;
(nnn) SEQ ID NOs: 834 and 922, respectively;
(ooo) SEQ ID NOs: 835 and 923, respectively;
(ppp) SEQ ID NOs: 836 and 924, respectively;
(qqq) SEQ ID NOs: 837 and 925, respectively;
(rrr) SEQ ID NOs: 838 and 926, respectively;
(sss) SEQ ID NOs: 839 and 927, respectively;
(ttt) SEQ ID NOs: 840 and 928, respectively;
(uuu) SEQ ID NOs: 1537 and 929, respectively;
(vvv) SEQ ID NOs: 842 and 930, respectively;
(www) SEQ ID NOs: 843 and 931, respectively;
(xxx) SEQ ID NOs: 844 and 932, respectively;
(yyy) SEQ ID NOs: 845 and 933, respectively;
(zzz) SEQ ID NOs: 846 and 934, respectively;
(aaaa) SEQ ID NOs: 847 and 935, respectively;
(bbbb) SEQ ID NOs: 848 and 936, respectively;
(cccc) SEQ ID NOs: 849 and 937, respectively;
(dddd) SEQ ID NOs: 850 and 938, respectively;
(eeee) SEQ ID NOs: 851 and 939, respectively;
(ffff) SEQ ID NOs: 852 and 940, respectively;
(gggg) SEQ ID NOs: 853 and 941, respectively;
(hhhh) SEQ ID NOs: 854 and 942, respectively;
(iiii) SEQ ID NOs: 855 and 943, respectively; and,
(jjjj) SEQ ID NOs: 856 and 944, respectively, wherein there is one or more (e.g., 1, 2, 3, 4 or 5) mismatch(s) between the sense and antisense strands.

In some embodiments, an oligonucleotide provided herein (e.g., an RNAi oligonucleotide) comprises a sense strand and an antisense strand comprising nucleotide sequences selected from:
(a) SEQ ID NOs: 786 and 874, respectively;
(b) SEQ ID NOs: 787 and 875, respectively;
(c) SEQ ID NOs: 1537 and 929, respectively; and,
(d) SEQ ID NOs: 813 and 901, respectively, wherein there is one or more (e.g., 1, 2, 3, 4, or 5) mismatch(s) between the sense and antisense strands.

Antisense Strands

In some embodiments, an antisense strand of an oligonucleotide herein (e.g., an RNAi oligonucleotide) is referred to as a "guide strand". For example, an antisense strand that engages with RNA-induced silencing complex (RISC) and binds to an Argonaute protein such as Ago2, or engages with or binds to one or more similar factors, and directs silencing of a target gene, as the antisense strand is referred to as a guide strand. In some embodiments, a sense strand comprising a region of complementary to a guide strand is referred to herein as a "passenger strand."

In some embodiments, an oligonucleotide herein (e.g., an RNAi oligonucleotide) comprises an antisense strand of up to about 50 nucleotides in length (e.g., up to 50, up to 40, up to 35, up to 30, up to 27, up to 25, up to 21, up to 19, up to 17, or up to 12 nucleotides in length).

In some embodiments, an oligonucleotide comprises an antisense strand of at least about 12 nucleotides in length (e.g., at least 12, at least 15, at least 19, at least 21, at least 22, at least 25, at least 27, at least 30, at least 35, or at least 38 nucleotides in length). In some embodiments, an oligonucleotide comprises an antisense strand in a range of about 12 to about 40 (e.g., 12 to 40, 12 to 36, 12 to 32, 12 to 28, 15 to 40, 15 to 36, 15 to 32, 15 to 28, 17 to 22, 17 to 25, 19 to 27, 19 to 30, 20 to 40, 22 to 40, 25 to 40, or 32 to 40) nucleotides in length. In some embodiments, an oligonucleotide comprises antisense strand of 15 to 30 nucleotides in length. In some embodiments, an antisense strand of any one of the oligonucleotides disclosed herein is of 12, 13, 14, 15, 16, 17, 18, 19, 20, 21, 22, 23, 24, 25, 26, 27, 28, 29, 30, 31, 32, 33, 34, 35, 36, 37, 38, 39, or 40 nucleotides in length. In some embodiments, an oligonucleotide comprises an antisense strand of 22 nucleotides in length.

In some embodiments, an oligonucleotide disclosed herein (e.g., an RNAi oligonucleotide) for targeting NR1H3 comprises an antisense strand comprising or consisting of a sequence as set forth in any one of SEQ ID NOs: 385-768. In some embodiments, an oligonucleotide herein comprises an antisense strand comprising at least about 12 (e.g., at least 12, at least 13, at least 14, at least 15, at least 16, at least 17, at least 18, at least 19, at least 20, at least 21, at least 22, or at least 23) contiguous nucleotides of a sequence as set forth in any one of SEQ ID NOs: 385-768. In some embodiments, an oligonucleotide disclosed herein for targeting NR1H3 comprises an antisense strand comprising or consisting of a sequence as set forth in any one of SEQ ID NOs: 857-944. In some embodiments, an oligonucleotide herein comprises an antisense strand comprising at least about 12 (e.g., at least 12, at least 13, at least 14, at least 15, at least 16, at least 17, at least 18, at least 19, at least 20, at least 21, at least 22, or at least 23) contiguous nucleotides of a sequence as set forth in any one of SEQ ID NOs: 857-944. In some embodiments, an oligonucleotide disclosed herein for targeting NR1H3 comprises an antisense strand comprising or consisting of a sequence as set forth in any one of SEQ ID NOs: 874, 875, 929, and 901. In some embodiments, an oligonucleotide herein comprises an antisense strand comprising at least about 12 (e.g., at least 12, at least 13, at least 14, at least 15, at least 16, at least 17, at least 18, at least 19, at least 20, at least 21, at least 22 or at least 23) contiguous nucleotides of a sequence as set forth in any one of SEQ ID NOs: 874, 875, 929, and 901.

In some embodiments, an oligonucleotide herein comprises an antisense strand comprising a nucleotide sequence selected from SEQ ID NOs: 1512-1515.

Sense Strands

In some embodiments, an oligonucleotide disclosed herein (e.g., an RNAi oligonucleotide) for targeting NR1H3 mRNA and inhibiting NR1H3 expression comprises a sense strand sequence as set forth in any one of SEQ ID NOs: 1-384. In some embodiments, an oligonucleotide disclosed herein (e.g., an RNAi oligonucleotide) for targeting NR1H3 mRNA and inhibiting NR1H3 expression comprises a sense strand sequence as set forth in any one of SEQ ID NOs: 1125-1511. In some embodiments, an oligonucleotide herein has a sense strand comprised of at least about 12 (e.g., at least 13, at least 14, at least 15, at least 16, at least 17, at least 18, at least 19, at least 20, at least 21, at least 22, or at least 23) contiguous nucleotides of a sequence as set forth in in any one of SEQ ID NOs: 1-384. In some embodiments, an oligonucleotide herein has a sense strand comprised of at least about 12 (e.g., at least 13, at least 14, at least 15, at least 16, at least 17, at least 18, at least 19, at least 20, at least 21, at least 22 or at least 23) contiguous nucleotides of a sequence as set forth in in any one of SEQ ID NOs: 1125-1511. In some embodiments, an oligonucleotide disclosed herein for targeting NR1H3 mRNA and inhibiting NR1H3 expression comprises a sense strand sequence as set forth in any one of SEQ ID NOs: 769-856. In some embodiments, an oligonucleotide disclosed herein for targeting NR1H3 mRNA and inhibiting NR1H3 expression comprises a sense strand sequence as set forth in any one of SEQ ID NOs: 1519-1552. In some embodiments, an oligonucleotide herein has a sense strand comprised of least about 12 (e.g., at least 13, at least 14, at least 15, at least 16, at least 17, at least 18, at least 19, at least 20, at least 21, at least 22, or at least 23) contiguous nucleotides of a sequence as set forth in any one of SEQ ID NOs: 769-856. In some embodiments, an oligonucleotide herein has a sense strand comprised of least about 12 (e.g., at least 13, at least 14, at least 15, at least 16, at least 17, at least 18, at least 19, at least 20, at least 21, at least 22, or at least 23) contiguous nucleotides of a sequence as set forth in any one of SEQ ID NOs: 1519-1552. In some embodiments, an oligonucleotide disclosed herein for targeting NR1H3 mRNA and inhibiting NR1H3 expression comprises a sense strand sequence as set forth in any one of SEQ ID NOs: 786, 787, 1537, and 813. In some embodiments, an oligonucleotide herein has a sense strand that comprise at least about 12 (e.g., at least 13, at least 14, at least 15, at least 16, at least 17, at least 18, at least 19, at least 20, at least 21, at least 22, or at least 23) contiguous nucleotides of a sequence as set forth in any one of SEQ ID NOs: 786, 787, 1537, and 813. In some embodiments, an oligonucleotide disclosed herein for targeting NR1H3 mRNA and inhibiting NR1H3 expression comprises a sense strand sequence as set forth in any one of SEQ ID NOs: 1409, 1509, 1510 and 1511. In some embodiments, an oligonucleotide herein has a sense strand that comprise at least about 12 (e.g., at least 13, at least 14, at least 15, at least 16, at least 17, at least 18, at least 19, at least 20, at least 21, at least 22 or at least 23) contiguous nucleotides of a sequence as set forth in any one of SEQ ID NOs: 1409, 1509, 1510 and 1511.

In some embodiments, an oligonucleotide provided herein (e.g., an RNAi oligonucleotide) comprises a sense strand (or passenger strand) of up to about 50 nucleotides in length (e.g., up to 50, up to 40, up to 36, up to 30, up to 27, up to 25, up to 21, up to 19, up to 17, or up to 12 nucleotides in length). In some embodiments, an oligonucleotide herein comprises a sense strand of at least about 12 nucleotides in length (e.g., at least 12, at least 15, at least 19, at least 21, at least 25, at least 27, at least 30, at least 36, or at least 38 nucleotides in length). In some embodiments, an oligonucleotide herein comprises a sense strand in a range of about 12 to about 50 (e.g., 12 to 50, 12 to 40, 12 to 36, 12 to 32, 12 to 28, 15 to 40, 15 to 36, 15 to 32, 15 to 28, 17 to 21, 17 to 25, 19 to 27, 19 to 30, 20 to 40, 22 to 40, 25 to 40, or 32 to 40) nucleotides in length. In some embodiments, an oligonucleotide herein comprises a sense strand of 15 to 50 nucleotides in length. In some embodiments, an oligonucleotide herein comprises a sense strand of 18 to 36 nucleotides in length. In some embodiments, an oligonucleotide herein comprises a sense strand of 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleotides in length. In some embodiments, an oligonucleotide herein comprises a sense strand of 36 nucleotides in length.

In some embodiments, an oligonucleotide provided herein (e.g., an RNAi oligonucleotide) comprises a sense strand comprising a stem-loop structure at the 3' end of the sense strand. In some embodiments, the stem-loop is formed by intrastrand base pairing. In some embodiments, a sense strand comprises a stem-loop structure at its 5' end. In some embodiments, the stem of the stem-loop comprises a duplex of 2, 3, 4, 5, 6, 7, 8, 9, 10, 11, 12, 13, or 14 nucleotides in length. In some embodiments, the stem of the stem-loop comprises a duplex of 2 nucleotides in length. In some embodiments, the stem of the stem-loop comprises a duplex of 3 nucleotides in length. In some embodiments, the stem of the stem-loop comprises a duplex of 4 nucleotides in length. In some embodiments, the stem of the stem-loop comprises a duplex of 5 nucleotides in length. In some embodiments, the stem of the stem-loop comprises a duplex of 6 nucleotides in length. In some embodiments, the stem of the stem-loop comprises a duplex of 7 nucleotides in length. In some embodiments, the stem of the stem-loop comprises a duplex of 8 nucleotides in length. In some embodiments, the stem of the stem-loop comprises a duplex of 9 nucleotides in length. In some embodiments, the stem of the stem-loop comprises a duplex of 10 nucleotides in length. In some embodiments, the stem of the stem-loop comprises a duplex of 11 nucleotides in length. In some embodiments, the stem of the stem-loop comprises a duplex of 12 nucleotides in length. In some embodiments, the stem of the stem-loop comprises a duplex of 13 nucleotides in length. In some embodiments, the stem of the stem-loop comprises a duplex of 14 nucleotides in length.

In some embodiments, a stem-loop provides the oligonucleotide protection against degradation (e.g., enzymatic degradation), facilitates or improves targeting and/or delivery to a target cell, tissue, or organ (e.g., the liver), or both. For example, in some embodiments, the loop of a stem-loop is comprised of nucleotides comprising one or more modifications that facilitate, improve, or increase targeting to a target mRNA (e.g., a NR1H3 mRNA), inhibition of target gene expression (e.g., NR1H3 expression), and/or delivery, uptake, and/or penetrance into a target cell, tissue, or organ (e.g., the liver), or a combination thereof. In some embodiments, the stem-loop itself or modification(s) to the stem-loop do not affect or do not substantially affect the inherent gene expression inhibition activity of the oligonucleotide, but facilitates, improves, or increases stability (e.g., provides protection against degradation) and/or delivery, uptake, and/or penetrance of the oligonucleotide to a target cell, tissue, or organ (e.g., the liver). In certain embodiments, an oligonucleotide herein comprises a sense strand comprising (e.g., at its 3' end) a stem-loop set forth as: S1-L-S2, in which S1 is complementary to S2, and in which L forms a single-stranded loop of linked nucleotides between S1 and S2 of up to about 10 nucleotides in length (e.g., 3, 4, 5, 6, 7, 8, 9 or 10 nucleotides in length). In some embodiments, the loop (L) is 3 nucleotides in length. In some embodiments, the loop (L) is 4 nucleotides in length. In some embodiments, the loop (L) is 5 nucleotides in length. In some embodiments, the loop (L) is 6 nucleotides in length. In some embodiments, the loop (L) is 7 nucleotides in length. In some embodiments, the loop (L) is 8 nucleotides in length. In some embodiments, the loop (L) is 9 nucleotides in length. In some embodiments, the loop (L) is 10 nucleotides in length.

In some embodiments, the tetraloop comprises the sequence 5'-GAAA-3'. In some embodiments, the stem loop comprises the sequence 5'-GCAGCCGAAAGGCUGC-3' (SEQ ID NO: 1121).

In some embodiments, an oligonucleotide provided herein (e.g., an RNAi oligonucleotide) comprises a targeting sequence or a region of complementary that is complementary to a contiguous sequence of nucleotides of any one of SEQ ID NOs: 1-384, and the oligonucleotide comprises a sense strand comprising (e.g., at its 3' end) a stem-loop set forth as: S1-L-S2, in which S1 is complementary to S2, and in which L forms a single-stranded loop between S1 and S2 of up to about 10 nucleotides in length (e.g., 3, 4, 5, 6, 7, 8, 9, or 10 nucleotides in length). In some embodiments, an oligonucleotide provided herein (e.g., an RNAi oligonucleotide) comprises a targeting sequence or a region of complementary that is complementary to a contiguous sequence of nucleotides of any one of SEQ ID NOs: 1125-1511, and the oligonucleotide comprises a sense strand comprising (e.g., at its 3' end) a stem-loop set forth as: S1-L-S2, in which S1 is complementary to S2, and in which L forms a single-stranded loop between S1 and S2 of up to about 10 nucleotides in length (e.g., 3, 4, 5, 6, 7, 8, 9, or 10 nucleotides in length). In some embodiments, the oligonucleotide comprises a targeting sequence or a region of complementary that is complementary to a contiguous sequence of nucleotides of any one of SEQ ID NOs: 1-384, and the oligonucleotide comprises a sense strand comprising (e.g., at its 3' end) a stem-loop set forth as: S1-L-S2, in which S1 is complementary to S2, and in which L forms a single-stranded loop between S1 and S2 of 4 nucleotides in length. In some embodiments, the oligonucleotide comprises a targeting sequence or a region of complementary that is complementary to a contiguous sequence of nucleotides of any one of SEQ ID NOs: 1125-1511, and the oligonucleotide comprises a sense strand comprising (e.g., at its 3' end) a stem-loop set forth as: S1-L-S2, in which S1 is complementary to S2, and in which L forms a single-stranded loop between S1 and S2 of 4 nucleotides in length.

In some embodiments, a loop (L) of a stem-loop having the structure S1-L-S2 as described herein is a triloop. In some embodiments, the oligonucleotide comprises a targeting sequence or a region of complementary that is complementary to a contiguous sequence of nucleotides of any one of SEQ ID NOs: 1-384 and a triloop. In some embodiments, the triloop comprises ribonucleotides, deoxyribonucleotides, modified nucleotides, ligands (e.g., delivery ligands), and combinations thereof. In some embodiments, a loop (L) of a stem-loop having the structure S1-L-S2 as described herein is a triloop. In some embodiments, the oligonucleotide comprises a targeting sequence or a region of complementary that is complementary to a contiguous sequence of nucleotides of any one of SEQ ID NOs: 1125-1511 and a triloop. In some embodiments, the triloop comprises ribonucleotides, deoxyribonucleotides, modified nucleotides, ligands (e.g., delivery ligands), and combinations thereof.

In some embodiments, a loop (L) of a stem-loop having the structure S1-L-S2 as described above is a tetraloop. In some embodiments, an oligonucleotide herein comprises a targeting sequence or a region of complementary that is complementary to a contiguous sequence of nucleotides of any one of SEQ ID NOs: 1-384 and a tetraloop. In some embodiments, the tetraloop comprises ribonucleotides, deoxyribonucleotides, modified nucleotides, ligands (e.g., delivery ligands), and combinations thereof. In some embodiments, a loop (L) of a stem-loop having the structure S1-L-S2 as described above is a tetraloop. In some embodiments, an oligonucleotide herein comprises a targeting sequence or a region of complementary that is complementary to a contiguous sequence of nucleotides of any one of SEQ ID NOs: 1125-1511 and a tetraloop. In some embodiments, the tetraloop comprises ribonucleotides, deoxyribonucleotides, modified nucleotides, ligands (e.g., delivery ligands), and combinations thereof.

Duplex Length

In some embodiments, a duplex formed between a sense and antisense strand is at least 12 (e.g., at least 15, at least 16, at least 17, at least 18, at least 19, at least 20, or at least 21) nucleotides in length. In some embodiments, a duplex formed between a sense and antisense strand is in the range of 12-30 nucleotides in length (e.g., 12 to 30, 12 to 27, 12 to 22, 15 to 25, 18 to 30, 18 to 22, 18 to 25, 18 to 27, 18 to 30, 19 to 30, or 21 to 30 nucleotides in length). In some embodiments, a duplex formed between a sense and antisense strand is 12, 13, 14, 15, 16, 17, 18, 19, 29, 21, 22, 23, 24, 25, 26, 27, 28, 29, or 30 nucleotides in length. In some embodiments, a duplex formed between a sense and antisense strand is 12 nucleotides in length. In some embodiments, a duplex formed between a sense and antisense strand is 13 nucleotides in length. In some embodiments, a duplex formed between a sense and antisense strand is 14 nucleotides in length. In some embodiments, a duplex formed between a sense and antisense strand is 15 nucleotides in length. In some embodiments, a duplex formed between a sense and antisense strand is 16 nucleotides in length. In some embodiments, a duplex formed between a sense and antisense strand is 17 nucleotides in length. In some embodiments, a duplex formed between a sense and antisense strand is 18 nucleotides in length. In some embodiments, a duplex formed between a sense and antisense strand is 19 nucleotides in length. In some embodiments, a duplex formed between a sense and antisense strand is 20 nucleotides in length. In some embodiments, a duplex formed between a sense and antisense strand is 21 nucleotides in length. In some embodiments, a duplex formed between a sense and antisense strand is 22 nucleotides in length. In some embodiments, a duplex formed between a sense and antisense strand is 23 nucleotides in length. In some embodiments, a duplex formed between a sense and antisense strand is 24 nucleotides in length. In some embodiments, a duplex formed between a sense and antisense strand is 25 nucleotides in length. In some embodiments, a duplex formed between a sense and antisense strand is 26 nucleotides in length. In some embodiments, a duplex formed between a sense and antisense strand is 27 nucleotides in length. In some embodiments, a duplex formed between a sense and antisense strand is 28 nucleotides in length. In some embodiments, a duplex formed between a sense and antisense strand is 29 nucleotides in length. In some embodiments, a duplex formed between a sense and antisense strand is 30 nucleotides in length. In some embodiments, a duplex formed between a sense and antisense strand does not span the entire length of the sense strand and/or antisense strand. In some embodiments, a duplex between a sense and antisense strand spans the entire length of either the sense or antisense strands. In some embodiments, a duplex between a sense and antisense strand spans the entire length of both the sense strand and the antisense strand. In some embodiments, the sense and antisense strands of an oligonucleotide comprise nucleotides sequences selected from the group consisting of:

(a) SEQ ID NOs: 769 and 857, respectively;
(b) SEQ ID NOs: 770 and 858, respectively;
(c) SEQ ID NOs: 771 and 859, respectively;
(d) SEQ ID NOs: 772 and 860, respectively;
(e) SEQ ID NOs: 773 and 861, respectively;
(f) SEQ ID NOs: 774 and 862, respectively;
(g) SEQ ID NOs: 775 and 863, respectively;
(h) SEQ ID NOs: 776 and 864, respectively;
(i) SEQ ID NOs: 777 and 865, respectively;
(j) SEQ ID NOs: 778 and 866, respectively;
(k) SEQ ID NOs: 779 and 867, respectively;
(l) SEQ ID NOs: 780 and 868, respectively;
(m) SEQ ID NOs: 781 and 869, respectively;
(n) SEQ ID NOs: 782 and 870, respectively;
(o) SEQ ID NOs: 783 and 871, respectively;
(p) SEQ ID NOs: 784 and 872, respectively;
(q) SEQ ID NOs: 785 and 873, respectively;
(r) SEQ ID NOs: 786 and 874, respectively;
(s) SEQ ID NOs: 787 and 875, respectively;
(t) SEQ ID NOs: 788 and 876, respectively;
(u) SEQ ID NOs: 789 and 877, respectively;
(v) SEQ ID NOs: 790 and 878, respectively;
(w) SEQ ID NOs: 791 and 879, respectively;
(x) SEQ ID NOs: 792 and 880, respectively;
(y) SEQ ID NOs: 793 and 881, respectively;
(z) SEQ ID NOs: 794 and 882, respectively;
(aa) SEQ ID NOs: 795 and 883, respectively;
(bb) SEQ ID NOs: 796 and 884, respectively;
(cc) SEQ ID NOs: 797 and 885, respectively;
(dd) SEQ ID NOs: 798 and 886, respectively;
(ee) SEQ ID NOs: 799 and 887, respectively;
(ff) SEQ ID NOs: 800 and 888, respectively;
(gg) SEQ ID NOs: 801 and 889, respectively;
(hh) SEQ ID NOs: 802 and 890, respectively;
(ii) SEQ ID NOs: 803 and 891, respectively;
(jj) SEQ ID NOs: 804 and 892, respectively;
(kk) SEQ ID NOs: 805 and 893, respectively;
(ll) SEQ ID NOs: 806 and 894, respectively;
(mm) SEQ ID NOs: 807 and 895, respectively;
(nn) SEQ ID NOs: 808 and 896, respectively;
(oo) SEQ ID NOs: 809 and 897, respectively;
(pp) SEQ ID NOs: 810 and 898, respectively;
(qq) SEQ ID NOs: 811 and 899, respectively;
(rr) SEQ ID NOs: 812 and 900, respectively;
(ss) SEQ ID NOs: 813 and 901, respectively;
(tt) SEQ ID NOs: 814 and 902, respectively;
(uu) SEQ ID NOs: 815 and 903, respectively;
(vv) SEQ ID NOs: 816 and 904, respectively;
(ww) SEQ ID NOs: 817 and 905, respectively;
(xx) SEQ ID NOs: 818 and 906, respectively;
(yy) SEQ ID NOs: 819 and 907, respectively;
(zz) SEQ ID NOs: 820 and 908, respectively;
(aaa) SEQ ID NOs: 821 and 909, respectively;
(bbb) SEQ ID NOs: 822 and 910, respectively;
(ccc) SEQ ID NOs: 823 and 911, respectively;
(ddd) SEQ ID NOs: 824 and 912, respectively;
(eee) SEQ ID NOs: 825 and 913, respectively;
(fff) SEQ ID NOs: 826 and 914, respectively;
(ggg) SEQ ID NOs: 827 and 915, respectively;
(hhh) SEQ ID NOs: 828 and 916, respectively;
(iii) SEQ ID NOs: 829 and 917, respectively;
(jjj) SEQ ID NOs: 830 and 918, respectively;
(kkk) SEQ ID NOs: 831 and 919, respectively;
(lll) SEQ ID NOs: 832 and 920, respectively;
(mmm) SEQ ID NOs: 833 and 921, respectively;
(nnn) SEQ ID NOs: 834 and 922, respectively;
(ooo) SEQ ID NOs: 835 and 923, respectively;
(ppp) SEQ ID NOs: 836 and 924, respectively;
(qqq) SEQ ID NOs: 837 and 925, respectively;
(rrr) SEQ ID NOs: 838 and 926, respectively;
(sss) SEQ ID NOs: 839 and 927, respectively;
(ttt) SEQ ID NOs: 840 and 928, respectively;
(uuu) SEQ ID NOs: 1537 and 929, respectively;
(vvv) SEQ ID NOs: 842 and 930, respectively;
(www) SEQ ID NOs: 843 and 931, respectively;
(xxx) SEQ ID NOs: 844 and 932, respectively;
(yyy) SEQ ID NOs: 845 and 933, respectively;
(zzz) SEQ ID NOs: 846 and 934, respectively;
(aaaa) SEQ ID NOs: 847 and 935, respectively;
(bbbb) SEQ ID NOs: 848 and 936, respectively;
(cccc) SEQ ID NOs: 849 and 937, respectively;
(dddd) SEQ ID NOs: 850 and 938, respectively;
(eeee) SEQ ID NOs: 851 and 939, respectively;
(ffff) SEQ ID NOs: 852 and 940, respectively;
(gggg) SEQ ID NOs: 853 and 941, respectively;
(hhhh) SEQ ID NOs: 854 and 942, respectively;
(iiii) SEQ ID NOs: 855 and 943, respectively; and,
(jjjj) SEQ ID NOs: 856 and 944, respectively,
wherein a duplex formed between a sense and antisense strand is in the range of 12-30 nucleotides in length (e.g., 12 to 30, 12 to 27, 12 to 22, 15 to 25, 18 to 30, 18 to 22, 18 to 25, 18 to 27, 18 to 30, 19 to 30, or 21 to 30 nucleotides in length)

In some embodiments, a duplex between a sense and antisense strand spans the entire length of both the sense strand and the antisense strand. In some embodiments, the sense and antisense strands of an oligonucleotide comprise nucleotides sequences selected from the group consisting of:
(a) SEQ ID NOs: 786 and 874, respectively;
(b) SEQ ID NOs: 787 and 875, respectively;
(c) SEQ ID NOs: 1537 and 929, respectively; and,
(d) SEQ ID NOs: 813 and 901, respectively,
wherein a duplex formed between a sense and antisense strand is in the range of 12-30 nucleotides in length (e.g., 12 to 30, 12 to 27, 12 to 22, 15 to 25, 18 to 30, 18 to 22, 18 to 25, 18 to 27, 18 to 30, 19 to 30, or 21 to 30 nucleotides in length)

Oligonucleotide Termini

In some embodiments, an oligonucleotide disclosed herein (e.g., an RNAi oligonucleotide) comprises a sense strand and an antisense strand, wherein the termini of either or both strands comprise a blunt end. In some embodiments, an oligonucleotide herein comprises sense and antisense strands that are separate strands which form an asymmetric duplex region having an overhang at the 3' terminus of the antisense strand. In some embodiments, an oligonucleotide herein comprises a sense strand and an antisense strand, wherein the termini of either or both strands comprise an overhang comprising one or more nucleotides. In some embodiments, the one or more nucleotides comprising the overhang are unpaired nucleotides. In some embodiments, an oligonucleotide herein comprises a sense strand and an antisense strand, wherein the 3' termini of the sense strand and the 5' termini of the antisense strand comprise a blunt end. In some embodiments, an oligonucleotide herein comprises a sense strand and an antisense strand, wherein the 5' termini of the sense strand and the 3' termini of the antisense strand comprise a blunt end.

In some embodiments, an oligonucleotide herein comprises a sense strand and an antisense strand, wherein the 3' terminus of either or both strands comprise a 3'-overhang comprising one or more nucleotides. In some embodiments, an oligonucleotide herein comprises a sense strand and an antisense strand, wherein the sense strand comprises a 3'-overhang comprising one or more nucleotides. In some embodiments, an oligonucleotide herein comprises a sense strand and an antisense strand, wherein the antisense strand comprises a 3'-overhang comprising one or more nucleotides. In some embodiments, an oligonucleotide herein comprises a sense strand and an antisense strand, wherein both the sense strand and the antisense strand comprises a 3'-overhang comprising one or more nucleotides.

In some embodiments, the 3'-overhang is about one (1) to twenty (20) nucleotides in length (e.g., about 1, 2, 3, 4, 5, 6, 7, 8, 9, 10, 11, 12, 13, 14, 15, 16, 17, 18, 19, or about 20 nucleotides in length). In some embodiments, the 3'-overhang is about one (1) to nineteen (19), one (1) to eighteen (18), one (1) to seventeen (17), one (1) to sixteen (16), one (1) to fifteen (15), one (1) to fourteen (14), one (1) to thirteen (13), one (1) to twelve (12), one (1) to eleven (11), one (1) to ten (10), one (1) to nine (9), one (1) to eight (8), one (1) to seven (7), one (1) to six (6), one (1) to five (5), one (1) to four (4), one (1) to three (3), or about one (1) to two (2) nucleotides in length. In some embodiments, the 3'-overhang is (1) nucleotide in length. In some embodiments, the 3'-overhang is two (2) nucleotides in length. In some embodiments, the 3'-overhang is three (3) nucleotides in length. In some embodiments, the 3'-overhang is four (4) nucleotides in length. In some embodiments, the 3'-overhang is five (5) nucleotides in length. In some embodiments, the 3'-overhang is six (6) nucleotides in length. In some embodiments, the 3'-overhang is seven (7) nucleotides in length. In some embodiments, the 3'-overhang is eight (8) nucleotides in length. In some embodiments, the 3'-overhang is nine (9) nucleotides in length. In some embodiments, the 3'-overhang is ten (10) nucleotides in length. In some embodiments, the 3'-overhang is eleven (11) nucleotides in length. In some embodiments, the 3'-overhang is twelve (12) nucleotides in length. In some embodiments, the 3'-overhang is thirteen (13) nucleotides in length. In some embodiments, the 3'-overhang is fourteen (14) nucleotides in length. In some embodiments, the 3'-overhang is fifteen (15) nucleotides in length. In some embodiments, the 3'-overhang is sixteen (16) nucleotides in length. In some embodiments, the 3'-overhang is seventeen (17) nucleotides in length. In some embodiments, the 3'-overhang is eighteen (18) nucleotides in length. In some embodiments, the 3'-overhang is nineteen (19) nucleotides in length. In some embodiments, the 3'-overhang is twenty (20) nucleotides in length.

In some embodiments, an oligonucleotide disclosed herein (e.g., an RNAi oligonucleotide) comprises a sense strand and an antisense strand, wherein the antisense strand comprises a 3'-overhang, wherein the sense and antisense strands of the oligonucleotide comprise nucleotides sequences selected from the group consisting of:

(a) SEQ ID NOs: 769 and 857, respectively;
(b) SEQ ID NOs: 770 and 858, respectively;
(c) SEQ ID NOs: 771 and 859, respectively;
(d) SEQ ID NOs: 772 and 860, respectively;
(e) SEQ ID NOs: 773 and 861, respectively;
(f) SEQ ID NOs: 774 and 862, respectively;
(g) SEQ ID NOs: 775 and 863, respectively;
(h) SEQ ID NOs: 776 and 864, respectively;
(i) SEQ ID NOs: 777 and 865, respectively;
(j) SEQ ID NOs: 778 and 866, respectively;
(k) SEQ ID NOs: 779 and 867, respectively;
(l) SEQ ID NOs: 780 and 868, respectively;
(m) SEQ ID NOs: 781 and 869, respectively;
(n) SEQ ID NOs: 782 and 870, respectively;
(o) SEQ ID NOs: 783 and 871, respectively;
(p) SEQ ID NOs: 784 and 872, respectively;
(q) SEQ ID NOs: 785 and 873, respectively;
(r) SEQ ID NOs: 786 and 874, respectively;
(s) SEQ ID NOs: 787 and 875, respectively;
(t) SEQ ID NOs: 788 and 876, respectively;
(u) SEQ ID NOs: 789 and 877, respectively;
(v) SEQ ID NOs: 790 and 878, respectively;
(w) SEQ ID NOs: 791 and 879, respectively;
(x) SEQ ID NOs: 792 and 880, respectively;
(y) SEQ ID NOs: 793 and 881, respectively;
(z) SEQ ID NOs: 794 and 882, respectively;
(aa) SEQ ID NOs: 795 and 883, respectively;
(bb) SEQ ID NOs: 796 and 884, respectively;
(cc) SEQ ID NOs: 797 and 885, respectively;
(dd) SEQ ID NOs: 798 and 886, respectively;
(ee) SEQ ID NOs: 799 and 887, respectively;
(ff) SEQ ID NOs: 800 and 888, respectively;
(gg) SEQ ID NOs: 801 and 889, respectively;
(hh) SEQ ID NOs: 802 and 890, respectively;
(ii) SEQ ID NOs: 803 and 891, respectively;
(jj) SEQ ID NOs: 804 and 892, respectively;
(kk) SEQ ID NOs: 805 and 893, respectively;
(ll) SEQ ID NOs: 806 and 894, respectively;
(mm) SEQ ID NOs: 807 and 895, respectively;
(nn) SEQ ID NOs: 808 and 896, respectively;
(oo) SEQ ID NOs: 809 and 897, respectively;
(pp) SEQ ID NOs: 810 and 898, respectively;
(qq) SEQ ID NOs: 811 and 899, respectively;
(rr) SEQ ID NOs: 812 and 900, respectively;
(ss) SEQ ID NOs: 813 and 901, respectively;
(tt) SEQ ID NOs: 814 and 902, respectively;
(uu) SEQ ID NOs: 815 and 903, respectively;
(vv) SEQ ID NOs: 816 and 904, respectively;
(ww) SEQ ID NOs: 817 and 905, respectively;
(xx) SEQ ID NOs: 818 and 906, respectively;
(yy) SEQ ID NOs: 819 and 907, respectively;
(zz) SEQ ID NOs: 820 and 908, respectively;

(aaa) SEQ ID NOs: 821 and 909, respectively;
(bbb) SEQ ID NOs: 822 and 910, respectively;
(ccc) SEQ ID NOs: 823 and 911, respectively;
(ddd) SEQ ID NOs: 824 and 912, respectively;
(eee) SEQ ID NOs: 825 and 913, respectively;
(fff) SEQ ID NOs: 826 and 914, respectively;
(ggg) SEQ ID NOs: 827 and 915, respectively;
(hhh) SEQ ID NOs: 828 and 916, respectively;
(iii) SEQ ID NOs: 829 and 917, respectively;
(jjj) SEQ ID NOs: 830 and 918, respectively;
(kkk) SEQ ID NOs: 831 and 919, respectively;
(lll) SEQ ID NOs: 832 and 920, respectively;
(mmm) SEQ ID NOs: 833 and 921, respectively;
(nnn) SEQ ID NOs: 834 and 922, respectively;
(ooo) SEQ ID NOs: 835 and 923, respectively;
(ppp) SEQ ID NOs: 836 and 924, respectively;
(qqq) SEQ ID NOs: 837 and 925, respectively;
(rrr) SEQ ID NOs: 838 and 926, respectively;
(sss) SEQ ID NOs: 839 and 927, respectively;
(ttt) SEQ ID NOs: 840 and 928, respectively;
(uuu) SEQ ID NOs: 1537 and 929, respectively;
(vvv) SEQ ID NOs: 842 and 930, respectively;
(www) SEQ ID NOs: 843 and 931, respectively;
(xxx) SEQ ID NOs: 844 and 932, respectively;
(yyy) SEQ ID NOs: 845 and 933, respectively;
(zzz) SEQ ID NOs: 846 and 934, respectively;
(aaaa) SEQ ID NOs: 847 and 935, respectively;
(bbbb) SEQ ID NOs: 848 and 936, respectively;
(cccc) SEQ ID NOs: 849 and 937, respectively;
(dddd) SEQ ID NOs: 850 and 938, respectively;
(eeee) SEQ ID NOs: 851 and 939, respectively;
(ffff) SEQ ID NOs: 852 and 940, respectively;
(gggg) SEQ ID NOs: 853 and 941, respectively;
(hhhh) SEQ ID NOs: 854 and 942, respectively;
(iiii) SEQ ID NOs: 855 and 943, respectively; and,
(jjjj) SEQ ID NOs: 856 and 944, respectively,
and wherein the antisense strand comprises a 3'-overhang about one (1) to twenty (20) nucleotides in length (e.g., about 1, 2, 3, 4, 5, 6, 7, 8, 9, 10, 11, 12, 13, 14, 15, 16, 17, 18, 19, or about 20 nucleotides in length), optionally wherein the 3'-overhang is two (2) nucleotides in length.

In some embodiments, an oligonucleotide disclosed herein (e.g., an RNAi oligonucleotide) comprises a sense strand and an antisense strand, wherein the antisense strand comprises a 3'-overhang, wherein the sense and antisense strands of the oligonucleotide comprise nucleotides sequences selected from the group consisting of:
(a) SEQ ID NOs: 786 and 874, respectively;
(b) SEQ ID NOs: 787 and 875, respectively;
(c) SEQ ID NOs: 1537 and 929, respectively; and,
(d) SEQ ID NOs: 813 and 901, respectively,
and wherein the antisense strand comprises a 3'-overhang about one (1) to twenty (20) nucleotides in length (e.g., about 1, 2, 3, 4, 5, 6, 7, 8, 9, 10, 11, 12, 13, 14, 15, 16, 17, 18, 19, or about 20 nucleotides in length), optionally wherein the 3'-overhang is two (2) nucleotides in length.

In some embodiments, an oligonucleotide herein comprises a sense strand and an antisense strand, wherein the 5' terminus of either or both strands comprise a 5'-overhang comprising one or more nucleotides. In some embodiments, an oligonucleotide herein comprises a sense strand and an antisense strand, wherein the sense strand comprises a 5'-overhang comprising one or more nucleotides. In some embodiments, an oligonucleotide herein comprises a sense strand and an antisense strand, wherein the antisense strand comprises a 5'-overhang comprising one or more nucleotides. In some embodiments, an oligonucleotide herein comprises a sense strand and an antisense strand, wherein both the sense strand and the antisense strand comprises a 5'-overhang comprising one or more nucleotides.

In some embodiments, the 5'-overhang is about one (1) to twenty (20) nucleotides in length (e.g., about 1, 2, 3, 4, 5, 6, 7, 8, 9, 10, 11, 12, 13, 14, 15, 16, 17, 18, 19, or about 20 nucleotides in length). In some embodiments, the 5'-overhang is about one (1) to nineteen (19), one (1) to eighteen (18), one (1) to seventeen (17), one (1) to sixteen (16), one (1) to fifteen (15), one (1) to fourteen (14), one (1) to thirteen (13), one (1) to twelve (12), one (1) to eleven (11), one (1) to ten (10), one (1) to nine (9), one (1) to eight (8), one (1) to seven (7), one (1) to six (6), one (1) to five (5), one (1) to four (4), one (1) to three (3), or about one (1) to two (2) nucleotides in length. In some embodiments, the 5'-overhang is (1) nucleotide in length. In some embodiments, the 5'-overhang is two (2) nucleotides in length. In some embodiments, the 5'-overhang is three (3) nucleotides in length. In some embodiments, the 5'-overhang is four (4) nucleotides in length. In some embodiments, the 5'-overhang is five (5) nucleotides in length. In some embodiments, the 5'-overhang is six (6) nucleotides in length. In some embodiments, the 5'-overhang is seven (7) nucleotides in length. In some embodiments, the 5'-overhang is eight (8) nucleotides in length. In some embodiments, the 5'-overhang is nine (9) nucleotides in length. In some embodiments, the 5'-overhang is ten (10) nucleotides in length. In some embodiments, the 5'-overhang is eleven (11) nucleotides in length. In some embodiments, the 5'-overhang is twelve (12) nucleotides in length. In some embodiments, the 5'-overhang is thirteen (13) nucleotides in length. In some embodiments, the 5'-overhang is fourteen (14) nucleotides in length. In some embodiments, the 5'-overhang is fifteen (15) nucleotides in length. In some embodiments, the 5'-overhang is sixteen (16) nucleotides in length. In some embodiments, the 5'-overhang is seventeen (17) nucleotides in length. In some embodiments, the 5'-overhang is eighteen (18) nucleotides in length. In some embodiments, the 5'-overhang is nineteen (19) nucleotides in length. In some embodiments, the 5'-overhang is twenty (20) nucleotides in length.

In some embodiments, an oligonucleotide disclosed herein (e.g., an RNAi oligonucleotide) comprises a sense strand and an antisense strand, wherein the antisense strand comprises a 5'-overhang, wherein the sense and antisense strands of the oligonucleotide comprise nucleotides sequences selected from the group consisting of:
(a) SEQ ID NOs: 769 and 857, respectively;
(b) SEQ ID NOs: 770 and 858, respectively;
(c) SEQ ID NOs: 771 and 859, respectively;
(d) SEQ ID NOs: 772 and 860, respectively;
(e) SEQ ID NOs: 773 and 861, respectively;
(f) SEQ ID NOs: 774 and 862, respectively;
(g) SEQ ID NOs: 775 and 863, respectively;
(h) SEQ ID NOs: 776 and 864, respectively;
(i) SEQ ID NOs: 777 and 865, respectively;
(j) SEQ ID NOs: 778 and 866, respectively;
(k) SEQ ID NOs: 779 and 867, respectively;
(l) SEQ ID NOs: 780 and 868, respectively;
(m) SEQ ID NOs: 781 and 869, respectively;
(n) SEQ ID NOs: 782 and 870, respectively;
(o) SEQ ID NOs: 783 and 871, respectively;
(p) SEQ ID NOs: 784 and 872, respectively;
(q) SEQ ID NOs: 785 and 873, respectively;
(r) SEQ ID NOs: 786 and 874, respectively;
(s) SEQ ID NOs: 787 and 875, respectively;
(t) SEQ ID NOs: 788 and 876, respectively;

(u) SEQ ID NOs: 789 and 877, respectively;
(v) SEQ ID NOs: 790 and 878, respectively;
(w) SEQ ID NOs: 791 and 879, respectively;
(x) SEQ ID NOs: 792 and 880, respectively;
(y) SEQ ID NOs: 793 and 881, respectively;
(z) SEQ ID NOs: 794 and 882, respectively;
(aa) SEQ ID NOs: 795 and 883, respectively;
(bb) SEQ ID NOs: 796 and 884, respectively;
(cc) SEQ ID NOs: 797 and 885, respectively;
(dd) SEQ ID NOs: 798 and 886, respectively;
(ee) SEQ ID NOs: 799 and 887, respectively;
(ff) SEQ ID NOs: 800 and 888, respectively;
(gg) SEQ ID NOs: 801 and 889, respectively;
(hh) SEQ ID NOs: 802 and 890, respectively;
(ii) SEQ ID NOs: 803 and 891, respectively;
(jj) SEQ ID NOs: 804 and 892, respectively;
(kk) SEQ ID NOs: 805 and 893, respectively;
(ll) SEQ ID NOs: 806 and 894, respectively;
(mm) SEQ ID NOs: 807 and 895, respectively;
(nn) SEQ ID NOs: 808 and 896, respectively;
(oo) SEQ ID NOs: 809 and 897, respectively;
(pp) SEQ ID NOs: 810 and 898, respectively;
(qq) SEQ ID NOs: 811 and 899, respectively;
(rr) SEQ ID NOs: 812 and 900, respectively;
(ss) SEQ ID NOs: 813 and 901, respectively;
(tt) SEQ ID NOs: 814 and 902, respectively;
(uu) SEQ ID NOs: 815 and 903, respectively;
(vv) SEQ ID NOs: 816 and 904, respectively;
(ww) SEQ ID NOs: 817 and 905, respectively;
(xx) SEQ ID NOs: 818 and 906, respectively;
(yy) SEQ ID NOs: 819 and 907, respectively;
(zz) SEQ ID NOs: 820 and 908, respectively;
(aaa) SEQ ID NOs: 821 and 909, respectively;
(bbb) SEQ ID NOs: 822 and 910, respectively;
(ccc) SEQ ID NOs: 823 and 911, respectively;
(ddd) SEQ ID NOs: 824 and 912, respectively;
(eee) SEQ ID NOs: 825 and 913, respectively;
(fff) SEQ ID NOs: 826 and 914, respectively;
(ggg) SEQ ID NOs: 827 and 915, respectively;
(hhh) SEQ ID NOs: 828 and 916, respectively;
(iii) SEQ ID NOs: 829 and 917, respectively;
(jjj) SEQ ID NOs: 830 and 918, respectively;
(kkk) SEQ ID NOs: 831 and 919, respectively;
(lll) SEQ ID NOs: 832 and 920, respectively;
(mmm) SEQ ID NOs: 833 and 921, respectively;
(nnn) SEQ ID NOs: 834 and 922, respectively;
(ooo) SEQ ID NOs: 835 and 923, respectively;
(ppp) SEQ ID NOs: 836 and 924, respectively;
(qqq) SEQ ID NOs: 837 and 925, respectively;
(rrr) SEQ ID NOs: 838 and 926, respectively;
(sss) SEQ ID NOs: 839 and 927, respectively;
(ttt) SEQ ID NOs: 840 and 928, respectively;
(uuu) SEQ ID NOs: 1537 and 929, respectively;
(vvv) SEQ ID NOs: 842 and 930, respectively;
(www) SEQ ID NOs: 843 and 931, respectively;
(xxx) SEQ ID NOs: 844 and 932, respectively;
(yyy) SEQ ID NOs: 845 and 933, respectively;
(zzz) SEQ ID NOs: 846 and 934, respectively;
(aaaa) SEQ ID NOs: 847 and 935, respectively;
(bbbb) SEQ ID NOs: 848 and 936, respectively;
(cccc) SEQ ID NOs: 849 and 937, respectively;
(dddd) SEQ ID NOs: 850 and 938, respectively;
(eeee) SEQ ID NOs: 851 and 939, respectively;
(ffff) SEQ ID NOs: 852 and 940, respectively;
(gggg) SEQ ID NOs: 853 and 941, respectively;
(hhhh) SEQ ID NOs: 854 and 942, respectively;
(iiii) SEQ ID NOs: 855 and 943, respectively; and,
(jjjj) SEQ ID NOs: 856 and 944, respectively, and wherein the antisense strand comprises a 3'-overhang about one (1) to twenty (20) nucleotides in length (e.g., about 1, 2, 3, 4, 5, 6, 7, 8, 9, 10, 11, 12, 13, 14, 15, 16, 17, 18, 19, or about 20 nucleotides in length), optionally wherein the 3'-overhang is two (2) nucleotides in length.

In some embodiments, an oligonucleotide disclosed herein (e.g., an RNAi oligonucleotide) comprises a sense strand and an antisense strand, wherein the antisense strand comprises a 5'-overhang, wherein the sense and antisense strands of the oligonucleotide comprise nucleotides sequences selected from the group consisting of:
(a) SEQ ID NOs: 786 and 874, respectively;
(b) SEQ ID NOs: 787 and 875, respectively;
(c) SEQ ID NOs: 1537 and 929, respectively; and,
(d) SEQ ID NOs: 813 and 901, respectively, and wherein the antisense strand comprises a 5'-overhang about one (1) to twenty (20) nucleotides in length (e.g., about 1, 2, 3, 4, 5, 6, 7, 8, 9, 10, 11, 12, 13, 14, 15, 16, 17, 18, 19, or about 20 nucleotides in length), optionally wherein the 5'-overhang is two (2) nucleotides in length.

In some embodiments, one or more (e.g., 2, 3, 4, 5, or more) nucleotides comprising the 3' terminus or 5' terminus of a sense and/or antisense strand are modified. For example, in some embodiments, one or two terminal nucleotides of the 3' terminus of the antisense strand are modified. In some embodiments, the last nucleotide at the 3' terminus of an antisense strand is modified, e.g., comprises 2' modification, e.g., a 2'-O-methoxyethyl. In some embodiments, an oligonucleotide provided herein comprises a sense strand having the sugar moiety at positions 1-7, 12-27 and 31-36 modified with 2'OMe. In some embodiments, the last one or two terminal nucleotides at the 3' terminus of an antisense strand are complementary with the target. In some embodiments, the last one or two nucleotides at the 3' terminus of the antisense strand are not complementary with the target.

In some embodiments, an oligonucleotide disclosed herein (e.g., an RNAi oligonucleotide) comprises a sense strand and an antisense strand, wherein the 3' terminus of the sense strand comprises a stem-loop described herein (see FIG. 1A) and the 3' terminus of the antisense strand comprises a 3'-overhang described herein. In some embodiments, an oligonucleotide herein (e.g., an RNAi oligonucleotide) comprises a sense strand and an antisense strand that form a nicked tetraloop structure described herein (see FIG. 1A), wherein the 3' terminus of the sense strand comprises a stem-loop, wherein the loop is a tetraloop described herein, and wherein the 3' terminus of the antisense strand comprises a 3'-overhang described herein (see FIG. 1A). In some embodiments, the 3'-overhang is two (2) nucleotides in length. In some embodiments, the two (2) nucleotides comprising the 3'-overhang both comprise guanine (G) nucleobases. Typically, one or both of the nucleotides comprising the 3'-overhang of the antisense strand are not complementary with the target mRNA.

Oligonucleotide Modifications

In some embodiments, an oligonucleotide described herein (e.g., an RNAi oligonucleotide) comprises a modification. Oligonucleotides (e.g., RNAi oligonucleotides) may be modified in various ways to improve or control specificity, stability, delivery, bioavailability, resistance from nuclease degradation, immunogenicity, base-pairing properties, RNA distribution and cellular uptake and other features relevant to therapeutic or research use.

In some embodiments, the modification is a modified sugar. In some embodiments, the modification is a 5'-terminal phosphate group. In some embodiments, the modification is a modified internucleotide linkage. In some embodiments, the modification is a modified base. In some embodiments, an oligonucleotide described herein can comprise any one of the modifications described herein or any combination thereof. For example, in some embodiments, an oligonucleotide described herein comprises at least one modified sugar, a 5'-terminal phosphate group, at least one modified internucleotide linkage, and at least one modified base. In some embodiments, the sense and antisense strands of an oligonucleotide comprise nucleotides sequences selected from the group consisting of:

(a) SEQ ID NOs: 769 and 857, respectively;
(b) SEQ ID NOs: 770 and 858, respectively;
(c) SEQ ID NOs: 771 and 859, respectively;
(d) SEQ ID NOs: 772 and 860, respectively;
(e) SEQ ID NOs: 773 and 861, respectively;
(f) SEQ ID NOs: 774 and 862, respectively;
(g) SEQ ID NOs: 775 and 863, respectively;
(h) SEQ ID NOs: 776 and 864, respectively;
(i) SEQ ID NOs: 777 and 865, respectively;
(j) SEQ ID NOs: 778 and 866, respectively;
(k) SEQ ID NOs: 779 and 867, respectively;
(l) SEQ ID NOs: 780 and 868, respectively;
(m) SEQ ID NOs: 781 and 869, respectively;
(n) SEQ ID NOs: 782 and 870, respectively;
(o) SEQ ID NOs: 783 and 871, respectively;
(p) SEQ ID NOs: 784 and 872, respectively;
(q) SEQ ID NOs: 785 and 873, respectively;
(r) SEQ ID NOs: 786 and 874, respectively;
(s) SEQ ID NOs: 787 and 875, respectively;
(t) SEQ ID NOs: 788 and 876, respectively;
(u) SEQ ID NOs: 789 and 877, respectively;
(v) SEQ ID NOs: 790 and 878, respectively;
(w) SEQ ID NOs: 791 and 879, respectively;
(x) SEQ ID NOs: 792 and 880, respectively;
(y) SEQ ID NOs: 793 and 881, respectively;
(z) SEQ ID NOs: 794 and 882, respectively;
(aa) SEQ ID NOs: 795 and 883, respectively;
(bb) SEQ ID NOs: 796 and 884, respectively;
(cc) SEQ ID NOs: 797 and 885, respectively;
(dd) SEQ ID NOs: 798 and 886, respectively;
(ee) SEQ ID NOs: 799 and 887, respectively;
(ff) SEQ ID NOs: 800 and 888, respectively;
(gg) SEQ ID NOs: 801 and 889, respectively;
(hh) SEQ ID NOs: 802 and 890, respectively;
(ii) SEQ ID NOs: 803 and 891, respectively;
(jj) SEQ ID NOs: 804 and 892, respectively;
(kk) SEQ ID NOs: 805 and 893, respectively;
(ll) SEQ ID NOs: 806 and 894, respectively;
(mm) SEQ ID NOs: 807 and 895, respectively;
(nn) SEQ ID NOs: 808 and 896, respectively;
(oo) SEQ ID NOs: 809 and 897, respectively;
(pp) SEQ ID NOs: 810 and 898, respectively;
(qq) SEQ ID NOs: 811 and 899, respectively;
(rr) SEQ ID NOs: 812 and 900, respectively;
(ss) SEQ ID NOs: 813 and 901, respectively;
(tt) SEQ ID NOs: 814 and 902, respectively;
(uu) SEQ ID NOs: 815 and 903, respectively;
(vv) SEQ ID NOs: 816 and 904, respectively;
(ww) SEQ ID NOs: 817 and 905, respectively;
(xx) SEQ ID NOs: 818 and 906, respectively;
(yy) SEQ ID NOs: 819 and 907, respectively;
(zz) SEQ ID NOs: 820 and 908, respectively;
(aaa) SEQ ID NOs: 821 and 909, respectively;
(bbb) SEQ ID NOs: 822 and 910, respectively;
(ccc) SEQ ID NOs: 823 and 911, respectively;
(ddd) SEQ ID NOs: 824 and 912, respectively;
(eee) SEQ ID NOs: 825 and 913, respectively;
(fff) SEQ ID NOs: 826 and 914, respectively;
(ggg) SEQ ID NOs: 827 and 915, respectively;
(hhh) SEQ ID NOs: 828 and 916, respectively;
(iii) SEQ ID NOs: 829 and 917, respectively;
(jjj) SEQ ID NOs: 830 and 918, respectively;
(kkk) SEQ ID NOs: 831 and 919, respectively;
(lll) SEQ ID NOs: 832 and 920, respectively;
(mmm) SEQ ID NOs: 833 and 921, respectively;
(nnn) SEQ ID NOs: 834 and 922, respectively;
(ooo) SEQ ID NOs: 835 and 923, respectively;
(ppp) SEQ ID NOs: 836 and 924, respectively;
(qqq) SEQ ID NOs: 837 and 925, respectively;
(rrr) SEQ ID NOs: 838 and 926, respectively;
(sss) SEQ ID NOs: 839 and 927, respectively;
(ttt) SEQ ID NOs: 840 and 928, respectively;
(uuu) SEQ ID NOs: 1537 and 929, respectively;
(vvv) SEQ ID NOs: 842 and 930, respectively;
(www) SEQ ID NOs: 843 and 931, respectively;
(xxx) SEQ ID NOs: 844 and 932, respectively;
(yyy) SEQ ID NOs: 845 and 933, respectively;
(zzz) SEQ ID NOs: 846 and 934, respectively;
(aaaa) SEQ ID NOs: 847 and 935, respectively;
(bbbb) SEQ ID NOs: 848 and 936, respectively;
(cccc) SEQ ID NOs: 849 and 937, respectively;
(dddd) SEQ ID NOs: 850 and 938, respectively;
(eeee) SEQ ID NOs: 851 and 939, respectively;
(ffff) SEQ ID NOs: 852 and 940, respectively;
(gggg) SEQ ID NOs: 853 and 941, respectively;
(hhhh) SEQ ID NOs: 854 and 942, respectively;
(iiii) SEQ ID NOs: 855 and 943, respectively; and,
(jjjj) SEQ ID NOs: 856 and 944, respectively,
wherein the oligonucleotide comprises at least one modified sugar, a 5'-terminal phosphate group, at least one modified internucleotide linkage, and at least one modified base.

In some embodiments, an oligonucleotide described herein comprises at least one modified sugar, a 5'-terminal phosphate group, at least one modified internucleotide linkage, and at least one modified base. In some embodiments, the sense and antisense strands of an oligonucleotide comprise nucleotides sequences selected from the group consisting of:

(a) SEQ ID NOs: 786 and 874, respectively;
(b) SEQ ID NOs: 787 and 875, respectively;
(c) SEQ ID NOs: 1537 and 929, respectively; and,
(d) SEQ ID NOs: 813 and 901, respectively,
wherein the oligonucleotide comprises at least one modified sugar, a 5'-terminal phosphate group, at least one modified internucleotide linkage, and at least one modified base.

The number of modifications on an oligonucleotide (e.g., an RNAi oligonucleotide) and the position of those nucleotide modifications may influence the properties of an oligonucleotide. For example, oligonucleotides may be delivered in vivo by conjugating them to or encompassing them in a lipid nanoparticle (LNP) or similar carrier. However, when an oligonucleotide is not protected by an LNP or similar carrier, it may be advantageous for at least some of the nucleotides to be modified. Accordingly, in some embodiments, all or substantially all the nucleotides of an oligonucleotide are modified. In some embodiments, more than half of the nucleotides are modified. In some embodiments, less than half of the nucleotides are modified. In some embodiments, the sugar moiety of all nucleotides comprising the oligonucleotide is modified at the 2' position. The modifications may be reversible or irreversible. In some embodiments, an oligonucleotide as disclosed herein has a number and type of modified nucleotides sufficient to cause the desired characteristics (e.g., protection from enzymatic degradation, capacity to target a desired cell after in vivo administration, and/or thermodynamic stability).

Sugar Modifications

In some embodiments, an oligonucleotide described herein (e.g., an RNAi oligonucleotide) comprises a modified sugar. In some embodiments, a modified sugar (also referred herein to a sugar analog) includes a modified deoxyribose or ribose moiety in which, for example, one or more modifications occur at the 2', 3', 4' and/or 5' carbon position of the sugar. In some embodiments, a modified sugar may also include non-natural alternative carbon structures such as those present in locked nucleic acids ("LNA"; see, e.g., Koshkin et al. TETRAHEDON (1998); 54: 3607-30), unlocked nucleic acids ("UNA"; see, e.g., Snead et al. MOL. THER-NUCL. ACIDS (2013); 2: e103) and bridged nucleic acids ("BNA"; see, e.g., Imanishi & Obika CHEM. COMMUN. (CAMB) (2002); 21: 1653-59).

In some embodiments, a nucleotide modification in a sugar comprises a 2'-modification. In some embodiments, a 2'-modification may be 2'-O-propargyl, 2'-O-propylamin, 2'-amino, 2'-ethyl, 2'-fluoro (2'-F), 2'-aminoethyl (EA), 2'-O-methyl (2'-OMe), 2'-O-methoxyethyl (2'-MOE), 2'-O-[2-(methylamino)-2-oxoethyl] (2'-O-NMA) or 2'-deoxy-2'-fluoro-β-d-arabinonucleic acid (2'-FANA). In some embodiments, the modification is 2'-F, 2'-OMe or 2'-MOE. In some embodiments, a modification in a sugar comprises a modification of the sugar ring, which may comprise modification of one or more carbons of the sugar ring. For example, a modification of a sugar of a nucleotide may comprise a 2'-oxygen of a sugar is linked to a 1'-carbon or 4'-carbon of the sugar, or a 2'-oxygen is linked to the 1'-carbon or 4'-carbon via an ethylene or methylene bridge. In some embodiments, a modified nucleotide has an acyclic sugar that lacks a 2'-carbon to 3'-carbon bond. In some embodiments, a modified nucleotide has a thiol group, e.g., in the 4' position of the sugar.

In some embodiments, an oligonucleotide (e.g., an RNAi oligonucleotide) described herein comprises at least about 1 modified nucleotide (e.g., at least 1, at least 5, at least 10, at least 15, at least 20, at least 25, at least 30, at least 35, at least 40, at least 45, at least 50, at least 55, at least 60, or more). In some embodiments, the sense strand of the oligonucleotide comprises at least about 1 modified nucleotide (e.g., at least 1, at least 5, at least 10, at least 15, at least 20, at least 25, at least 30, at least 35, or more). In some embodiments, the antisense strand of the oligonucleotide comprises at least about 1 modified nucleotide (e.g., at least 1, at least 5, at least 10, at least 15, at least 20, or more).

In some embodiments, all the nucleotides of the sense strand of the oligonucleotide are modified. In some embodiments, all the nucleotides of the antisense strand of the oligonucleotide are modified. In some embodiments, all the nucleotides of the oligonucleotide (i.e., both the sense strand and the antisense strand) are modified. In some embodiments, the modified nucleotide comprises a 2'-modification (e.g., a 2'-F or 2'-OMe, 2'-MOE, and 2'-deoxy-2'-fluoro-β-d-arabinonucleic acid).

In some embodiments, the disclosure provides oligonucleotides having different modification patterns. In some embodiments, an oligonucleotide herein comprises a sense strand having a modification pattern as set forth in the Examples and Sequence Listing and an antisense strand having a modification pattern as set forth in the Examples and Sequence Listing.

In some embodiments, an oligonucleotide disclosed herein (e.g., an RNAi oligonucleotide) comprises an antisense strand having nucleotides that are modified with 2'-F. In some embodiments, an oligonucleotide herein comprises an antisense strand comprising nucleotides that are modified with 2'-F and 2'-OMe. In some embodiments, an oligonucleotide disclosed herein comprises a sense strand having nucleotides that are modified with 2'-F. In some embodiments, an oligonucleotide disclosed herein comprises a sense strand comprises nucleotides that are modified with 2'-F and 2'-OMe.

In some embodiments, an oligonucleotide described herein comprises a sense strand with about 10-15%, 10%, 11%, 12%, 13%, 14%, or 15% of the nucleotides of the sense strand comprising a 2'-fluoro modification. In some embodiments, about 11% of the nucleotides of the sense strand comprise a 2-fluoro modification. In some embodiments, an oligonucleotide described herein comprises an antisense strand with about 25-35%, 25%, 26%, 27%, 28%, 29%, 30%, 31%, 32%, 33%, 34%, or 35% of the nucleotides of the antisense strand comprising a 2'-fluoro modification. In some embodiments, about 32% of the nucleotides of the antisense strand comprise a 2'-fluoro modification. In some embodiments, the oligonucleotide has about 15-25%, 15%, 16%, 17%, 18%, 19%, 20%, 21%, 22%, 23%, 24%, or 25% of its nucleotides comprising a 2'-fluoro modification. In some embodiments, about 19% of the nucleotides in the dsRNAi oligonucleotide comprise a 2'-fluoro modification.

In some embodiments, one or more of positions 8, 9, 10, or 11 of the sense strand is modified with a 2'-F group. In some embodiments, one or more of positions 3, 8, 9, 10, 12, 13, and 17 of the sense strand is modified with a 2'-F group. In some embodiments, one or more of positions 2, 3, 4, 5, 7, 10, and 14 of the antisense strand is modified with a 2'-F group. In some embodiments, one or more of positions 2, 3, 4, 5, 7, 8, 10, 14, 16, and 19 is modified with a 2'-F group. In some embodiments, the sugar moiety at each of nucleotides at positions 1-7 and 12-20 in the sense strand is modified with a 2'-OMe. In some embodiments, the sugar moiety at each of nucleotides at positions 1-7, 12-27, and 31-36 in the sense strand is modified with a 2'-OMe. In some embodiments, the sugar moiety at each of nucleotides at positions 6, 9, 11-13, 15, 17, 18, and 20-22 in the sense strand is modified with a 2'-OMe.

In some embodiments, the sense and antisense strands of an oligonucleotide comprise nucleotides sequences selected from the group consisting of:
(a) SEQ ID NOs: 769 and 857, respectively;
(b) SEQ ID NOs: 770 and 858, respectively;
(c) SEQ ID NOs: 771 and 859, respectively;
(d) SEQ ID NOs: 772 and 860, respectively;
(e) SEQ ID NOs: 773 and 861, respectively;
(f) SEQ ID NOs: 774 and 862, respectively;
(g) SEQ ID NOs: 775 and 863, respectively;
(h) SEQ ID NOs: 776 and 864, respectively;
(i) SEQ ID NOs: 777 and 865, respectively;
(j) SEQ ID NOs: 778 and 866, respectively;
(k) SEQ ID NOs: 779 and 867, respectively;
(l) SEQ ID NOs: 780 and 868, respectively;
(m) SEQ ID NOs: 781 and 869, respectively;
(n) SEQ ID NOs: 782 and 870, respectively;
(o) SEQ ID NOs: 783 and 871, respectively;
(p) SEQ ID NOs: 784 and 872, respectively;
(q) SEQ ID NOs: 785 and 873, respectively;
(r) SEQ ID NOs: 786 and 874, respectively;
(s) SEQ ID NOs: 787 and 875, respectively;
(t) SEQ ID NOs: 788 and 876, respectively;
(u) SEQ ID NOs: 789 and 877, respectively;
(v) SEQ ID NOs: 790 and 878, respectively;

(w) SEQ ID NOs: 791 and 879, respectively;
(x) SEQ ID NOs: 792 and 880, respectively;
(y) SEQ ID NOs: 793 and 881, respectively;
(z) SEQ ID NOs: 794 and 882, respectively;
(aa) SEQ ID NOs: 795 and 883, respectively;
(bb) SEQ ID NOs: 796 and 884, respectively;
(cc) SEQ ID NOs: 797 and 885, respectively;
(dd) SEQ ID NOs: 798 and 886, respectively;
(ee) SEQ ID NOs: 799 and 887, respectively;
(ff) SEQ ID NOs: 800 and 888, respectively;
(gg) SEQ ID NOs: 801 and 889, respectively;
(hh) SEQ ID NOs: 802 and 890, respectively;
(ii) SEQ ID NOs: 803 and 891, respectively;
(jj) SEQ ID NOs: 804 and 892, respectively;
(kk) SEQ ID NOs: 805 and 893, respectively;
(ll) SEQ ID NOs: 806 and 894, respectively;
(mm) SEQ ID NOs: 807 and 895, respectively;
(nn) SEQ ID NOs: 808 and 896, respectively;
(oo) SEQ ID NOs: 809 and 897, respectively;
(pp) SEQ ID NOs: 810 and 898, respectively;
(qq) SEQ ID NOs: 811 and 899, respectively;
(rr) SEQ ID NOs: 812 and 900, respectively;
(ss) SEQ ID NOs: 813 and 901, respectively;
(tt) SEQ ID NOs: 814 and 902, respectively;
(uu) SEQ ID NOs: 815 and 903, respectively;
(vv) SEQ ID NOs: 816 and 904, respectively;
(ww) SEQ ID NOs: 817 and 905, respectively;
(xx) SEQ ID NOs: 818 and 906, respectively;
(yy) SEQ ID NOs: 819 and 907, respectively;
(zz) SEQ ID NOs: 820 and 908, respectively;
(aaa) SEQ ID NOs: 821 and 909, respectively;
(bbb) SEQ ID NOs: 822 and 910, respectively;
(ccc) SEQ ID NOs: 823 and 911, respectively;
(ddd) SEQ ID NOs: 824 and 912, respectively;
(eee) SEQ ID NOs: 825 and 913, respectively;
(fff) SEQ ID NOs: 826 and 914, respectively;
(ggg) SEQ ID NOs: 827 and 915, respectively;
(hhh) SEQ ID NOs: 828 and 916, respectively;
(iii) SEQ ID NOs: 829 and 917, respectively;
(jjj) SEQ ID NOs: 830 and 918, respectively;
(kkk) SEQ ID NOs: 831 and 919, respectively;
(lll) SEQ ID NOs: 832 and 920, respectively;
(mmm) SEQ ID NOs: 833 and 921, respectively;
(nnn) SEQ ID NOs: 834 and 922, respectively;
(ooo) SEQ ID NOs: 835 and 923, respectively;
(ppp) SEQ ID NOs: 836 and 924, respectively;
(qqq) SEQ ID NOs: 837 and 925, respectively;
(rrr) SEQ ID NOs: 838 and 926, respectively;
(sss) SEQ ID NOs: 839 and 927, respectively;
(ttt) SEQ ID NOs: 840 and 928, respectively;
(uuu) SEQ ID NOs: 1537 and 929, respectively;
(vvv) SEQ ID NOs: 842 and 930, respectively;
(www) SEQ ID NOs: 843 and 931, respectively;
(xxx) SEQ ID NOs: 844 and 932, respectively;
(yyy) SEQ ID NOs: 845 and 933, respectively;
(zzz) SEQ ID NOs: 846 and 934, respectively;
(aaaa) SEQ ID NOs: 847 and 935, respectively;
(bbbb) SEQ ID NOs: 848 and 936, respectively;
(cccc) SEQ ID NOs: 849 and 937, respectively;
(dddd) SEQ ID NOs: 850 and 938, respectively;
(eeee) SEQ ID NOs: 851 and 939, respectively;
(ffff) SEQ ID NOs: 852 and 940, respectively;
(gggg) SEQ ID NOs: 853 and 941, respectively;
(hhhh) SEQ ID NOs: 854 and 942, respectively;
(iiii) SEQ ID NOs: 855 and 943, respectively; and,
(jjjj) SEQ ID NOs: 856 and 944, respectively,
wherein one or more of positions 8, 9, 10 or 11 of the sense strand is modified with a 2'-F group.

In some embodiments, the sense and antisense strands of an oligonucleotide comprise nucleotides sequences selected from the group consisting of:
(a) SEQ ID NOs: 786 and 874, respectively;
(b) SEQ ID NOs: 787 and 875, respectively;
(c) SEQ ID NOs: 1537 and 929, respectively, and;
(d) SEQ ID NOs: 813 and 901, respectively,
wherein one or more of positions 8, 9, 10, or 11 of the sense strand is modified with a 2'-F group.

In some embodiments, an oligonucleotide provided herein comprises an antisense strand having the sugar moiety of each of the nucleotides at positions 2, 5, and 14 of the antisense strand modified with 2'-F and the sugar moiety of each of the remaining nucleotides of the antisense strand modified with a modification selected from the group consisting of 2'-O-propargyl, 2'-O-propylamin, 2'-amino, 2'-ethyl, 2'-aminoethyl (EA), 2'-O-methyl (2'-OMe), 2'-O-methoxyethyl (2'-MOE), 2'-O-[2-(methylamino)-2-oxo-ethyl] (2'-O-NMA), and 2'-deoxy-2'-fluoro-β-d-arabino-nucleic acid (2'-FANA).

In some embodiments, an oligonucleotide provided herein comprises an antisense strand having the sugar moiety of each of the nucleotides at positions 1, 2, 5, and 14 of the antisense strand modified with 2'-F and the sugar moiety of each of the remaining nucleotides of the antisense strand modified with a modification selected from the group consisting of 2'-O-propargyl, 2'-O-propylamin, 2'-amino, 2'-ethyl, 2'-aminoethyl (EA), 2'-O-methyl (2'-OMe), 2'-O-methoxyethyl (2'-MOE), 2'-O-[2-(methylamino)-2-oxo-ethyl] (2'-O-NMA), and 2'-deoxy-2'-fluoro-β-d-arabino-nucleic acid (2'-FANA).

In some embodiments, an oligonucleotide provided herein comprises an antisense strand having the sugar moiety of each of the nucleotides at positions 2, 4, 5, and 14 of the antisense strand modified with 2'-F and the sugar moiety of each of the remaining nucleotides of the antisense strand modified with a modification selected from the group consisting of 2'-O-propargyl, 2'-O-propylamin, 2'-amino, 2'-ethyl, 2'-aminoethyl (EA), 2'-O-methyl (2'-OMe), 2'-O-methoxyethyl (2'-MOE), 2'-O-[2-(methylamino)-2-oxo-ethyl] (2'-O-NMA), and 2'-deoxy-2'-fluoro-β-d-arabino-nucleic acid (2'-FANA).

In some embodiments, an oligonucleotide provided herein comprises an antisense strand having the sugar moiety of each of the nucleotides at positions 1, 2, 3, 5, 7, and 14 of the antisense strand modified with 2'-F and the sugar moiety of each of the remaining nucleotides of the antisense strand modified with a modification selected from the group consisting of 2'-O-propargyl, 2'-O-propylamin, 2'-amino, 2'-ethyl, 2'-aminoethyl (EA), 2'-O-methyl (2'-OMe), 2'-O-methoxyethyl (2'-MOE), 2'-O-[2-(methylamino)-2-oxo-ethyl] (2'-O-NMA), and 2'-deoxy-2'-fluoro-β-d-arabino-nucleic acid (2'-FANA).

In some embodiments, an oligonucleotide provided herein comprises an antisense strand having the sugar moiety of each of the nucleotides at positions 2, 3, 4, 5, 7, and 14 of the antisense strand modified with 2'-F and the sugar moiety of each of the remaining nucleotides of the antisense strand modified with a modification selected from the group consisting of 2'-O-propargyl, 2'-O-propylamin, 2'-amino, 2'-ethyl, 2'-aminoethyl (EA), 2'-O-methyl (2'-OMe), 2'-O-methoxyethyl (2'-MOE), 2'-O-[2-(methylamino)-2-oxo-ethyl] (2'-O-NMA), and 2'-deoxy-2'-fluoro-β-d-arabino-nucleic acid (2'-FANA).

In some embodiments, an oligonucleotide provided herein comprises an antisense strand having the sugar moiety of each of the nucleotides at positions 1, 2, 3, 5, 10, and 14 of the antisense strand modified with 2'-F and the sugar moiety of each of the remaining nucleotides of the antisense strand modified with a modification selected from the group consisting of 2'-O-propargyl, 2'-O-propylamin, 2'-amino, 2'-ethyl, 2'-aminoethyl (EA), 2'-O-methyl (2'-OMe), 2'-O-methoxyethyl (2'-MOE), 2'-O-[2-(methylamino)-2-oxoethyl] (2'-O-NMA), and 2'-deoxy-2'-fluoro-β-d-arabinonucleic acid (2'-FANA).

In some embodiments, an oligonucleotide provided herein comprises an antisense strand having the sugar moiety of each of the nucleotides at positions 2, 3, 4, 5, 10, and 14 of the antisense strand modified with 2'-F and the sugar moiety of each of the remaining nucleotides of the antisense strand modified with a modification selected from the group consisting of 2'-O-propargyl, 2'-O-propylamin, 2'-amino, 2'-ethyl, 2'-aminoethyl (EA), 2'-O-methyl (2'-OMe), 2'-O-methoxyethyl (2'-MOE), 2'-O-[2-(methylamino)-2-oxoethyl] (2'-O-NMA), and 2'-deoxy-2'-fluoro-β-d-arabinonucleic acid (2'-FANA).

In some embodiments, an oligonucleotide provided herein comprises an antisense strand having the sugar moiety of each of the nucleotides at positions 2, 3, 5, 7, 10, and 14 of the antisense strand modified with 2'-F and the sugar moiety of each of the remaining nucleotides of the antisense strand modified with a modification selected from the group consisting of 2'-O-propargyl, 2'-O-propylamin, 2'-amino, 2'-ethyl, 2'-aminoethyl (EA), 2'-O-methyl (2'-OMe), 2'-O-methoxyethyl (2'-MOE), 2'-O-[2-(methylamino)-2-oxoethyl] (2'-O-NMA), and 2'-deoxy-2'-fluoro-β-d-arabinonucleic acid (2'-FANA).

In some embodiments, an oligonucleotide provided herein comprises an antisense strand having the sugar moiety of each of the nucleotides at positions 2, 3, 4, 5, 7, 10, and 14 of the antisense strand modified with 2'-F and the sugar moiety of each of the remaining nucleotides of the antisense strand modified with a modification selected from the group consisting of 2'-O-propargyl, 2'-O-propylamin, 2'-amino, 2'-ethyl, 2'-aminoethyl (EA), 2'-O-methyl (2'-OMe), 2'-O-methoxyethyl (2'-MOE), 2'-O-[2-(methylamino)-2-oxoethyl] (2'-O-NMA), and 2'-deoxy-2'-fluoro-β-d-arabinonucleic acid (2'-FANA).

In some embodiments, an oligonucleotide provided herein comprises an antisense strand having the sugar moiety of each of the nucleotides at positions 2, 3, 4, 5, 7, 8, 10, 14, 16, and 19 of the antisense strand modified with 2'-F and the sugar moiety of each of the remaining nucleotides of the antisense strand modified with a modification selected from the group consisting of 2'-O-propargyl, 2'-O-propylamin, 2'-amino, 2'-ethyl, 2'-aminoethyl (EA), 2'-O-methyl (2'-OMe), 2'-O-methoxyethyl (2'-MOE), 2'-O-[2-(methylamino)-2-oxoethyl] (2'-O-NMA), and 2'-deoxy-2'-fluoro-β-d-arabinonucleic acid (2'-FANA).

In some embodiments, an oligonucleotide provided herein comprises an antisense strand having the sugar moiety at position 1, position 2, position 3, position 4, position 5, position 6, position 7, position 8, position 9, position 10, position 11, position 12, position 13, position 14, position 15, position 16, position 17, position 18, position 19, position 20, position 21, or position 22 modified with 2'-F.

In some embodiments, an oligonucleotide provided herein comprises an antisense strand having the sugar moiety at position 1, position 2, position 3, position 4, position 5, position 6, position 7, position 8, position 9, position 10, position 11, position 12, position 13, position 14, position 15, position 16, position 17, position 18, position 19, position 20, position 21, or position 22 modified with 2'-OMe.

In some embodiments, an oligonucleotide provided herein comprises an antisense strand having the sugar moiety at position 1, position 2, position 3, position 4, position 5, position 6, position 7, position 8, position 9, position 10, position 11, position 12, position 13, position 14, position 15, position 16, position 17, position 18, position 19, position 20, position 21, or position 22 modified with a modification selected from the group consisting of 2'-O-propargyl, 2'-O-propylamin, 2'-amino, 2'-ethyl, 2'-aminoethyl (EA), 2'-O-methyl (2'-OMe), 2'-O-methoxyethyl (2'-MOE), 2'-O-[2-(methylamino)-2-oxoethyl] (2'-O-NMA), and 2'-deoxy-2'-fluoro-β-d-arabinonucleic acid (2'-FANA).

In some embodiments, an oligonucleotide provided herein comprises a sense strand having the sugar moiety at positions 8-11 modified with 2'-F. In some embodiments, an oligonucleotide provided herein comprises a sense strand having the sugar moiety at positions 3, 8, 9, 10, 12, 13 and 17 modified with 2'-F. In some embodiments, an oligonucleotide provided herein comprises a sense strand having the sugar moiety at positions 1-7 and 12-17 or 12-20 modified with 2'OMe. In some embodiments, an oligonucleotide provided herein comprises a sense strand having the sugar moiety of each of the nucleotides at positions 1-7 and 12-17 or 12-20 of the sense strand modified with a modification selected from the group consisting of 2'-O-propargyl, 2'-O-propylamin, 2'-amino, 2'-ethyl, 2'-aminoethyl (EA), 2'-O-methyl (2'-OMe), 2'-O-methoxyethyl (2'-MOE), 2'-O-[2-(methylamino)-2-oxoethyl] (2'-O-NMA), and 2'-deoxy-2'-fluoro-β-d-arabinonucleic acid (2'-FANA). In some embodiments, an oligonucleotide provided herein comprises a sense strand having the sugar moiety at positions 1-2, 4-7, 11, 14-16, and 18-20 modified with 2'OMe. In some embodiments, an oligonucleotide provided herein comprises a sense strand having the sugar moiety of each of the nucleotides at positions 1-2, 4-7, 11, 14-16, and 18-20 of the sense strand modified with a modification selected from the group consisting of 2'-O-propargyl, 2'-O-propylamin, 2'-amino, 2'-ethyl, 2'-aminoethyl (EA), 2'-O-methyl (2'-OMe), 2'-O-methoxyethyl (2'-MOE), 2'-O-[2-(methylamino)-2-oxoethyl] (2'-O-NMA), and 2'-deoxy-2'-fluoro-β-d-arabinonucleic acid (2'-FANA).

In some embodiments, an oligonucleotide provided herein comprises a sense strand having the sugar moiety at position 1, position 2, position 3, position 4, position 5, position 6, position 7, position 8, position 9, position 10, position 11, position 12, position 13, position 14, position 15, position 16, position 17, position 18, position 19, position 20, position 21, position 22, position 23, position 24, position 25, position 26, position 27, position 28, position 29, position 30, position 31, position 32, position 33, position 34, position 35, or position 36 modified with 2'-F.

In some embodiments, an oligonucleotide provided herein comprises a sense strand having the sugar moiety at position 1, position 2, position 3, position 4, position 5, position 6, position 7, position 8, position 9, position 10, position 11, position 12, position 13, position 14, position 15, position 16, position 17, position 18, position 19, position 20, position 21, position 22, position 23, position 24, position 25, position 26, position 27, position 28, position 29, position 30, position 31, position 32, position 33, position 34, position 35, or position 36 modified with 2'-OMe.

In some embodiments, an oligonucleotide provided herein comprises a sense strand having the sugar moiety at position 1, position 2, position 3, position 4, position 5, position 6, position 7, position 8, position 9, position 10, position 11, position 12, position 13, position 14, position 15, position 16, position 17, position 18, position 19, position 20, position 21, position 22, position 23, position 24, position 25, position 26, position 27, position 28, position 29, position 30, position 31, position 32, position 33, position 34, position 35, or position 36 modified with a modification selected from the group consisting of 2'-O-propargyl, 2'-O-propylamin, 2'-amino, 2'-ethyl, 2'-aminoethyl (EA), 2'-O-methyl (2'-OMe), 2'-O-methoxyethyl (2'-MOE), 2'-O-[2-(methylamino)-2-oxoethyl] (2'-O-NMA), and 2'-deoxy-2'-fluoro-β-d-arabinonucleic acid (2'-FANA).

5'-Terminal Phosphate

In some embodiments, an oligonucleotide described herein (e.g., an RNAi oligonucleotide) comprises a sense strand and an antisense strand, wherein the antisense strand comprises a 5'-terminal phosphate. In some embodiments, 5'-terminal phosphate groups of an RNAi oligonucleotide enhance the interaction with Ago2. However, oligonucleotides comprising a 5'-phosphate group may be susceptible to degradation via phosphatases or other enzymes, which can limit their performance and/or bioavailability in vivo. In some embodiments, an oligonucleotide herein includes analogs of 5' phosphates that are resistant to such degradation. In some embodiments, the phosphate analog is oxymethylphosphonate, vinylphosphonate or malonylphosphonate, or a combination thereof. In certain embodiments, the 5' terminus of an oligonucleotide strand is attached to chemical moiety that mimics the electrostatic and steric properties of a natural 5'-phosphate group ("phosphate mimic"). In some embodiments, the sense and antisense strands of an oligonucleotide comprise nucleotides sequences selected from the group consisting of:

(a) SEQ ID NOs: 769 and 857, respectively;
(b) SEQ ID NOs: 770 and 858, respectively;
(c) SEQ ID NOs: 771 and 859, respectively;
(d) SEQ ID NOs: 772 and 860, respectively;
(e) SEQ ID NOs: 773 and 861, respectively;
(f) SEQ ID NOs: 774 and 862, respectively;
(g) SEQ ID NOs: 775 and 863, respectively;
(h) SEQ ID NOs: 776 and 864, respectively;
(i) SEQ ID NOs: 777 and 865, respectively;
(j) SEQ ID NOs: 778 and 866, respectively;
(k) SEQ ID NOs: 779 and 867, respectively;
(l) SEQ ID NOs: 780 and 868, respectively;
(m) SEQ ID NOs: 781 and 869, respectively;
(n) SEQ ID NOs: 782 and 870, respectively;
(o) SEQ ID NOs: 783 and 871, respectively;
(p) SEQ ID NOs: 784 and 872, respectively;
(q) SEQ ID NOs: 785 and 873, respectively;
(r) SEQ ID NOs: 786 and 874, respectively;
(s) SEQ ID NOs: 787 and 875, respectively;
(t) SEQ ID NOs: 788 and 876, respectively;
(u) SEQ ID NOs: 789 and 877, respectively;
(v) SEQ ID NOs: 790 and 878, respectively;
(w) SEQ ID NOs: 791 and 879, respectively;
(x) SEQ ID NOs: 792 and 880, respectively;
(y) SEQ ID NOs: 793 and 881, respectively;
(z) SEQ ID NOs: 794 and 882, respectively;
(aa) SEQ ID NOs: 795 and 883, respectively;
(bb) SEQ ID NOs: 796 and 884, respectively;
(cc) SEQ ID NOs: 797 and 885, respectively;
(dd) SEQ ID NOs: 798 and 886, respectively;
(ee) SEQ ID NOs: 799 and 887, respectively;
(ff) SEQ ID NOs: 800 and 888, respectively;
(gg) SEQ ID NOs: 801 and 889, respectively;
(hh) SEQ ID NOs: 802 and 890, respectively;
(ii) SEQ ID NOs: 803 and 891, respectively;
(jj) SEQ ID NOs: 804 and 892, respectively;
(kk) SEQ ID NOs: 805 and 893, respectively;
(ll) SEQ ID NOs: 806 and 894, respectively;
(mm) SEQ ID NOs: 807 and 895, respectively;
(nn) SEQ ID NOs: 808 and 896, respectively;
(oo) SEQ ID NOs: 809 and 897, respectively;
(pp) SEQ ID NOs: 810 and 898, respectively;
(qq) SEQ ID NOs: 811 and 899, respectively;
(rr) SEQ ID NOs: 812 and 900, respectively;
(ss) SEQ ID NOs: 813 and 901, respectively;
(tt) SEQ ID NOs: 814 and 902, respectively;
(uu) SEQ ID NOs: 815 and 903, respectively;
(vv) SEQ ID NOs: 816 and 904, respectively;
(ww) SEQ ID NOs: 817 and 905, respectively;
(xx) SEQ ID NOs: 818 and 906, respectively;
(yy) SEQ ID NOs: 819 and 907, respectively;
(zz) SEQ ID NOs: 820 and 908, respectively;
(aaa) SEQ ID NOs: 821 and 909, respectively;
(bbb) SEQ ID NOs: 822 and 910, respectively;
(ccc) SEQ ID NOs: 823 and 911, respectively;
(ddd) SEQ ID NOs: 824 and 912, respectively;
(eee) SEQ ID NOs: 825 and 913, respectively;
(fff) SEQ ID NOs: 826 and 914, respectively;
(ggg) SEQ ID NOs: 827 and 915, respectively;
(hhh) SEQ ID NOs: 828 and 916, respectively;
(iii) SEQ ID NOs: 829 and 917, respectively;
(jjj) SEQ ID NOs: 830 and 918, respectively;
(kkk) SEQ ID NOs: 831 and 919, respectively;
(lll) SEQ ID NOs: 832 and 920, respectively;
(mmm) SEQ ID NOs: 833 and 921, respectively;
(nnn) SEQ ID NOs: 834 and 922, respectively;
(ooo) SEQ ID NOs: 835 and 923, respectively;
(ppp) SEQ ID NOs: 836 and 924, respectively;
(qqq) SEQ ID NOs: 837 and 925, respectively;
(rrr) SEQ ID NOs: 838 and 926, respectively;
(sss) SEQ ID NOs: 839 and 927, respectively;
(ttt) SEQ ID NOs: 840 and 928, respectively;
(uuu) SEQ ID NOs: 1537 and 929, respectively;
(vvv) SEQ ID NOs: 842 and 930, respectively;
(www) SEQ ID NOs: 843 and 931, respectively;
(xxx) SEQ ID NOs: 844 and 932, respectively;
(yyy) SEQ ID NOs: 845 and 933, respectively;
(zzz) SEQ ID NOs: 846 and 934, respectively;
(aaaa) SEQ ID NOs: 847 and 935, respectively;
(bbbb) SEQ ID NOs: 848 and 936, respectively;
(cccc) SEQ ID NOs: 849 and 937, respectively;
(dddd) SEQ ID NOs: 850 and 938, respectively;
(eeee) SEQ ID NOs: 851 and 939, respectively;
(ffff) SEQ ID NOs: 852 and 940, respectively;
(gggg) SEQ ID NOs: 853 and 941, respectively;
(hhhh) SEQ ID NOs: 854 and 942, respectively;
(iiii) SEQ ID NOs: 855 and 943, respectively; and,
(jjjj) SEQ ID NOs: 856 and 944, respectively,
wherein the oligonucleotide comprises a 5'-terminal phosphate, optionally a 5'-terminal phosphate analog.

In some embodiments, the sense and antisense strands of an oligonucleotide comprise nucleotides sequences selected from the group consisting of:

(a) SEQ ID NOs: 786 and 874, respectively;
(b) SEQ ID NOs: 787 and 875, respectively;
(c) SEQ ID NOs: 1537 and 929, respectively; and,
(d) SEQ ID NOs: 813 and 901, respectively,
wherein the oligonucleotide comprises a 5'-terminal phosphate, optionally a 5'-terminal phosphate analog.

In some embodiments, an oligonucleotide herein (e.g., an RNAi oligonucleotide) has a phosphate analog at a 4'-carbon position of the sugar (referred to as a "4'-phosphate analog").

See, e.g., Intl. Patent Application Publication No. WO 2018/045317. In some embodiments, an oligonucleotide herein comprises a 4'-phosphate analog at a 5'-terminal nucleotide. In some embodiments, a phosphate analog is an oxymethylphosphonate, in which the oxygen atom of the oxymethyl group is bound to the sugar moiety (e.g., at its 4'-carbon) or analog thereof. In other embodiments, a 4'-phosphate analog is a thiomethylphosphonate or an aminomethylphosphonate, in which the sulfur atom of the thiomethyl group or the nitrogen atom of the amino methyl group is bound to the 4'-carbon of the sugar moiety or analog thereof. In certain embodiments, a 4'-phosphate analog is an oxymethylphosphonate. In some embodiments, an oxymethylphosphonate is represented by the formula —O—CH$_2$—PO(OH)$_2$, —O—CH$_2$—PO(OR)$_2$, or —O—CH$_2$—PO(OH)(R), in which R is independently selected from —H, —CH$_3$, an alkyl group, —CH$_2$CH$_2$CN, —CH$_2$OCOC(CH$_3$)$_3$, —CH$_2$OCH$_2$CH$_2$Si(CH$_3$)$_3$ or a protecting group. In certain embodiments, the alkyl group is —CH$_2$CH$_3$. More typically, R is independently selected from H, —CH$_3$ or —CH$_2$CH$_3$. In some embodiment, R is —CH$_3$. In some embodiments, the 4'-phosphate analog is 5'-methoxyphosphonate-4'-oxy.

In some embodiments, an oligonucleotide provided herein comprises an antisense strand comprising a 4'-phosphate analog at the 5'-terminal nucleotide, wherein 5'-terminal nucleotide comprises the following structure (Chem. formula 1):

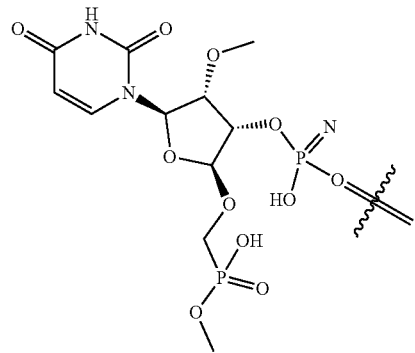

5'-methoxyphosphonate-4'-oxy-2'-O-methyluridine phosphorothioate [MePhosphonate-4O-mUs]

Modified Internucleotide Linkage

In some embodiments, an oligonucleotide provided herein (e.g., a RNAi oligonucleotide) comprises a modified internucleotide linkage. In some embodiments, phosphate modifications or substitutions result in an oligonucleotide that comprises at least about 1 (e.g., at least 1, at least 2, at least 3, or at least 5) modified internucleotide linkage. In some embodiments, any one of the oligonucleotides disclosed herein comprises about 1 to about 10 (e.g., 1 to 10, 2 to 8, 4 to 6, 3 to 10, 5 to 10, 1 to 5, 1 to 3, or 1 to 2) modified internucleotide linkages. In some embodiments, any one of the oligonucleotides disclosed herein comprises 1, 2, 3, 4, 5, 6, 7, 8, 9, or 10 modified internucleotide linkages.

A modified internucleotide linkage may be a phosphorodithioate linkage, a phosphorothioate linkage, a phosphotriester linkage, a thionoalkylphosphonate linkage, a thionalkylphosphotriester linkage, a phosphoramidite linkage, a phosphonate linkage or a boranophosphate linkage. In some embodiments, at least one modified internucleotide linkage of any one of the oligonucleotides as disclosed herein is a phosphorothioate linkage.

In some embodiments, an oligonucleotide provided herein (e.g., a RNAi oligonucleotide) has a phosphorothioate linkage between one or more of positions 1 and 2 of the sense strand, positions 1 and 2 of the antisense strand, positions 2 and 3 of the antisense strand, positions 3 and 4 of the antisense strand, positions 20 and 21 of the antisense strand, and positions 21 and 22 of the antisense strand. In some embodiments, the oligonucleotide described herein has a phosphorothioate linkage between each of positions 1 and 2 of the sense strand, positions 1 and 2 of the antisense strand, positions 2 and 3 of the antisense strand, positions 20 and 21 of the antisense strand, and positions 21 and 22 of the antisense strand. In some embodiments, the sense and antisense strands of an oligonucleotide comprise nucleotides sequences selected from the group consisting of:
(a) SEQ ID NOs: 769 and 857, respectively;
(b) SEQ ID NOs: 770 and 858, respectively;
(c) SEQ ID NOs: 771 and 859, respectively;
(d) SEQ ID NOs: 772 and 860, respectively;
(e) SEQ ID NOs: 773 and 861, respectively;
(f) SEQ ID NOs: 774 and 862, respectively;
(g) SEQ ID NOs: 775 and 863, respectively;
(h) SEQ ID NOs: 776 and 864, respectively;
(i) SEQ ID NOs: 777 and 865, respectively;
(j) SEQ ID NOs: 778 and 866, respectively;
(k) SEQ ID NOs: 779 and 867, respectively;
(l) SEQ ID NOs: 780 and 868, respectively;
(m) SEQ ID NOs: 781 and 869, respectively;
(n) SEQ ID NOs: 782 and 870, respectively;
(o) SEQ ID NOs: 783 and 871, respectively;
(p) SEQ ID NOs: 784 and 872, respectively;
(q) SEQ ID NOs: 785 and 873, respectively;
(r) SEQ ID NOs: 786 and 874, respectively;
(s) SEQ ID NOs: 787 and 875, respectively;
(t) SEQ ID NOs: 788 and 876, respectively;
(u) SEQ ID NOs: 789 and 877, respectively;
(v) SEQ ID NOs: 790 and 878, respectively;
(w) SEQ ID NOs: 791 and 879, respectively;
(x) SEQ ID NOs: 792 and 880, respectively;
(y) SEQ ID NOs: 793 and 881, respectively;
(z) SEQ ID NOs: 794 and 882, respectively;
(aa) SEQ ID NOs: 795 and 883, respectively;
(bb) SEQ ID NOs: 796 and 884, respectively;
(cc) SEQ ID NOs: 797 and 885, respectively;
(dd) SEQ ID NOs: 798 and 886, respectively;
(ee) SEQ ID NOs: 799 and 887, respectively;
(ff) SEQ ID NOs: 800 and 888, respectively;
(gg) SEQ ID NOs: 801 and 889, respectively;
(hh) SEQ ID NOs: 802 and 890, respectively;
(ii) SEQ ID NOs: 803 and 891, respectively;
(jj) SEQ ID NOs: 804 and 892, respectively;
(kk) SEQ ID NOs: 805 and 893, respectively;
(ll) SEQ ID NOs: 806 and 894, respectively;
(mm) SEQ ID NOs: 807 and 895, respectively;
(nn) SEQ ID NOs: 808 and 896, respectively;
(oo) SEQ ID NOs: 809 and 897, respectively;
(pp) SEQ ID NOs: 810 and 898, respectively;
(qq) SEQ ID NOs: 811 and 899, respectively;
(rr) SEQ ID NOs: 812 and 900, respectively;
(ss) SEQ ID NOs: 813 and 901, respectively;
(tt) SEQ ID NOs: 814 and 902, respectively;
(uu) SEQ ID NOs: 815 and 903, respectively;
(vv) SEQ ID NOs: 816 and 904, respectively;
(ww) SEQ ID NOs: 817 and 905, respectively;
(xx) SEQ ID NOs: 818 and 906, respectively;
(yy) SEQ ID NOs: 819 and 907, respectively;
(zz) SEQ ID NOs: 820 and 908, respectively;

(aaa) SEQ ID NOs: 821 and 909, respectively;
(bbb) SEQ ID NOs: 822 and 910, respectively;
(ccc) SEQ ID NOs: 823 and 911, respectively;
(ddd) SEQ ID NOs: 824 and 912, respectively;
(eee) SEQ ID NOs: 825 and 913, respectively;
(fff) SEQ ID NOs: 826 and 914, respectively;
(ggg) SEQ ID NOs: 827 and 915, respectively;
(hhh) SEQ ID NOs: 828 and 916, respectively;
(iii) SEQ ID NOs: 829 and 917, respectively;
(jjj) SEQ ID NOs: 830 and 918, respectively;
(kkk) SEQ ID NOs: 831 and 919, respectively;
(lll) SEQ ID NOs: 832 and 920, respectively;
(mmm) SEQ ID NOs: 833 and 921, respectively;
(nnn) SEQ ID NOs: 834 and 922, respectively;
(ooo) SEQ ID NOs: 835 and 923, respectively;
(ppp) SEQ ID NOs: 836 and 924, respectively;
(qqq) SEQ ID NOs: 837 and 925, respectively;
(rrr) SEQ ID NOs: 838 and 926, respectively;
(sss) SEQ ID NOs: 839 and 927, respectively;
(ttt) SEQ ID NOs: 840 and 928, respectively;
(uuu) SEQ ID NOs: 1537 and 929, respectively;
(vvv) SEQ ID NOs: 842 and 930, respectively;
(www) SEQ ID NOs: 843 and 931, respectively;
(xxx) SEQ ID NOs: 844 and 932, respectively;
(yyy) SEQ ID NOs: 845 and 933, respectively;
(zzz) SEQ ID NOs: 846 and 934, respectively;
(aaaa) SEQ ID NOs: 847 and 935, respectively;
(bbbb) SEQ ID NOs: 848 and 936, respectively;
(cccc) SEQ ID NOs: 849 and 937, respectively;
(dddd) SEQ ID NOs: 850 and 938, respectively;
(eeee) SEQ ID NOs: 851 and 939, respectively;
(ffff) SEQ ID NOs: 852 and 940, respectively;
(gggg) SEQ ID NOs: 853 and 941, respectively;
(hhhh) SEQ ID NOs: 854 and 942, respectively;
(iiii) SEQ ID NOs: 855 and 943, respectively; and,
(jjjj) SEQ ID NOs: 856 and 944, respectively,
wherein the oligonucleotide comprises a modified internucleotide linkage.

In some embodiments, the oligonucleotide described herein has a phosphorothioate linkage between each of positions 1 and 2 of the sense strand, positions 1 and 2 of the antisense strand, positions 2 and 3 of the antisense strand, positions 20 and 21 of the antisense strand, and positions 21 and 22 of the antisense strand. In some embodiments, the sense and antisense strands of an oligonucleotide comprise nucleotides sequences selected from the group consisting of:
(a) SEQ ID NOs: 786 and 874, respectively;
(b) SEQ ID NOs: 787 and 875, respectively;
(c) SEQ ID NOs: 1537 and 929, respectively, and;
(d) SEQ ID NOs: 813 and 901, respectively,
wherein the oligonucleotide comprises a modified internucleotide linkage.

Base Modifications

In some embodiments, an oligonucleotide provided herein (e.g., an RNAi oligonucleotides) comprises one or more modified nucleobases. In some embodiments, modified nucleobases (also referred to herein as base analogs) are linked at the 1' position of a nucleotide sugar moiety. In certain embodiments, a modified nucleobase is a nitrogenous base. In some embodiments, a modified nucleobase does not contain nitrogen atom. See, e.g., US Patent Application Publication No. 2008/0274462. In some embodiments, a modified nucleotide comprises a universal base. In some embodiments, a modified nucleotide does not contain a nucleobase (abasic). In some embodiments, the sense and antisense strands of an oligonucleotide comprise nucleotides sequences selected from the group consisting of:

(a) SEQ ID NOs: 769 and 857, respectively;
(b) SEQ ID NOs: 770 and 858, respectively;
(c) SEQ ID NOs: 771 and 859, respectively;
(d) SEQ ID NOs: 772 and 860, respectively;
(e) SEQ ID NOs: 773 and 861, respectively;
(f) SEQ ID NOs: 774 and 862, respectively;
(g) SEQ ID NOs: 775 and 863, respectively;
(h) SEQ ID NOs: 776 and 864, respectively;
(i) SEQ ID NOs: 777 and 865, respectively;
(j) SEQ ID NOs: 778 and 866, respectively;
(k) SEQ ID NOs: 779 and 867, respectively;
(l) SEQ ID NOs: 780 and 868, respectively;
(m) SEQ ID NOs: 781 and 869, respectively;
(n) SEQ ID NOs: 782 and 870, respectively;
(o) SEQ ID NOs: 783 and 871, respectively;
(p) SEQ ID NOs: 784 and 872, respectively;
(q) SEQ ID NOs: 785 and 873, respectively;
(r) SEQ ID NOs: 786 and 874, respectively;
(s) SEQ ID NOs: 787 and 875, respectively;
(t) SEQ ID NOs: 788 and 876, respectively;
(u) SEQ ID NOs: 789 and 877, respectively;
(v) SEQ ID NOs: 790 and 878, respectively;
(w) SEQ ID NOs: 791 and 879, respectively;
(x) SEQ ID NOs: 792 and 880, respectively;
(y) SEQ ID NOs: 793 and 881, respectively;
(z) SEQ ID NOs: 794 and 882, respectively;
(aa) SEQ ID NOs: 795 and 883, respectively;
(bb) SEQ ID NOs: 796 and 884, respectively;
(cc) SEQ ID NOs: 797 and 885, respectively;
(dd) SEQ ID NOs: 798 and 886, respectively;
(ee) SEQ ID NOs: 799 and 887, respectively;
(ff) SEQ ID NOs: 800 and 888, respectively;
(gg) SEQ ID NOs: 801 and 889, respectively;
(hh) SEQ ID NOs: 802 and 890, respectively;
(ii) SEQ ID NOs: 803 and 891, respectively;
(jj) SEQ ID NOs: 804 and 892, respectively;
(kk) SEQ ID NOs: 805 and 893, respectively;
(ll) SEQ ID NOs: 806 and 894, respectively;
(mm) SEQ ID NOs: 807 and 895, respectively;
(nn) SEQ ID NOs: 808 and 896, respectively;
(oo) SEQ ID NOs: 809 and 897, respectively;
(pp) SEQ ID NOs: 810 and 898, respectively;
(qq) SEQ ID NOs: 811 and 899, respectively;
(rr) SEQ ID NOs: 812 and 900, respectively;
(ss) SEQ ID NOs: 813 and 901, respectively;
(tt) SEQ ID NOs: 814 and 902, respectively;
(uu) SEQ ID NOs: 815 and 903, respectively;
(vv) SEQ ID NOs: 816 and 904, respectively;
(ww) SEQ ID NOs: 817 and 905, respectively;
(xx) SEQ ID NOs: 818 and 906, respectively;
(yy) SEQ ID NOs: 819 and 907, respectively;
(zz) SEQ ID NOs: 820 and 908, respectively;
(aaa) SEQ ID NOs: 821 and 909, respectively;
(bbb) SEQ ID NOs: 822 and 910, respectively;
(ccc) SEQ ID NOs: 823 and 911, respectively;
(ddd) SEQ ID NOs: 824 and 912, respectively;
(eee) SEQ ID NOs: 825 and 913, respectively;
(fff) SEQ ID NOs: 826 and 914, respectively;
(ggg) SEQ ID NOs: 827 and 915, respectively;
(hhh) SEQ ID NOs: 828 and 916, respectively;
(iii) SEQ ID NOs: 829 and 917, respectively;
(jjj) SEQ ID NOs: 830 and 918, respectively;
(kkk) SEQ ID NOs: 831 and 919, respectively;
(lll) SEQ ID NOs: 832 and 920, respectively;
(mmm) SEQ ID NOs: 833 and 921, respectively;
(nnn) SEQ ID NOs: 834 and 922, respectively;
(ooo) SEQ ID NOs: 835 and 923, respectively;

(ppp) SEQ ID NOs: 836 and 924, respectively;
(qqq) SEQ ID NOs: 837 and 925, respectively;
(rrr) SEQ ID NOs: 838 and 926, respectively;
(sss) SEQ ID NOs: 839 and 927, respectively;
(ttt) SEQ ID NOs: 840 and 928, respectively;
(uuu) SEQ ID NOs: 1537 and 929, respectively;
(vvv) SEQ ID NOs: 842 and 930, respectively;
(www) SEQ ID NOs: 843 and 931, respectively;
(xxx) SEQ ID NOs: 844 and 932, respectively;
(yyy) SEQ ID NOs: 845 and 933, respectively;
(zzz) SEQ ID NOs: 846 and 934, respectively;
(aaaa) SEQ ID NOs: 847 and 935, respectively;
(bbbb) SEQ ID NOs: 848 and 936, respectively;
(cccc) SEQ ID NOs: 849 and 937, respectively;
(dddd) SEQ ID NOs: 850 and 938, respectively;
(eeee) SEQ ID NOs: 851 and 939, respectively;
(ffff) SEQ ID NOs: 852 and 940, respectively;
(gggg) SEQ ID NOs: 853 and 941, respectively;
(hhhh) SEQ ID NOs: 854 and 942, respectively;
(iiii) SEQ ID NOs: 855 and 943, respectively; and,
(jjjj) SEQ ID NOs: 856 and 944, respectively,
wherein the oligonucleotide comprises one or more modified nucleobases.

In some embodiments, a modified nucleotide comprises a universal base. In some embodiments, a modified nucleotide does not contain a nucleobase (abasic). In some embodiments, the sense and antisense strands of an oligonucleotide comprise nucleotides sequences selected from the group consisting of:
(a) SEQ ID NOs: 786 and 874, respectively;
(b) SEQ ID NOs: 787 and 875, respectively;
(c) SEQ ID NOs: 1537 and 929, respectively; and,
(d) SEQ ID NOs: 813 and 901, respectively,
wherein the oligonucleotide comprises one or more modified nucleobases.

In some embodiments, a universal base is a heterocyclic moiety located at the 1' position of a nucleotide sugar moiety in a modified nucleotide, or the equivalent position in a nucleotide sugar moiety substitution, that, when present in a duplex, can be positioned opposite more than one type of base without substantially altering structure of the duplex. In some embodiments, compared to a reference single-stranded nucleic acid (e.g., oligonucleotide) that is fully complementary to a target nucleic acid (e.g., a NR1H3 mRNA), a single-stranded nucleic acid containing a universal base forms a duplex with the target nucleic acid that has a lower $T_m$ than a duplex formed with the complementary nucleic acid. In some embodiments, when compared to a reference single-stranded nucleic acid in which the universal base has been replaced with a base to generate a single mismatch, the single-stranded nucleic acid containing the universal base forms a duplex with the target nucleic acid that has a higher $T_m$ than a duplex formed with the nucleic acid comprising the mismatched base.

Non-limiting examples of universal-binding nucleotides include, but are not limited to, inosine, 1-β-D-ribofuranosyl-5-nitroindole and/or 1-β-D-ribofuranosyl-3-nitropyrrole (see, US Patent Application Publication No. 2007/0254362; Van Aerschot et al. NUCLEIC ACIDS RES. (1995); 23: 4363-4370; Loakes et al. NUCLEIC ACIDS RES. (1995); 23: 2361-66; and Loakes & Brown NUCLEIC ACIDS RES. (1994); 22: 4039-43).

Targeting Ligands

In some embodiments, it is desirable to target an oligonucleotide provided herein (e.g., an RNAi oligonucleotide) to one or more cells or cell type, tissues, organs, or anatomical regions or compartments. Such a strategy may help to avoid undesirable effects and/or to avoid undue loss of the oligonucleotide to cells, tissues, organs, or anatomical regions or compartments that would not benefit from the oligonucleotide or its effects (e.g., inhibition or reduction of NR1H3 expression). Accordingly, in some embodiments, oligonucleotides disclosed herein (e.g., RNAi oligonucleotides) are modified to facilitate targeting and/or delivery to particular cells or cell types, tissues, organs, or anatomical regions or compartments (e.g., to facilitate delivery of the oligonucleotide to the liver). In some embodiments, an oligonucleotide comprises at least one nucleotide (e.g., 1, 2, 3, 4, 5, 6, or more nucleotides) conjugated to one or more targeting ligand(s). In some embodiments, the sense and antisense strands of an oligonucleotide comprise nucleotides sequences selected from the group consisting of:
(a) SEQ ID NOs: 769 and 857, respectively;
(b) SEQ ID NOs: 770 and 858, respectively;
(c) SEQ ID NOs: 771 and 859, respectively;
(d) SEQ ID NOs: 772 and 860, respectively;
(e) SEQ ID NOs: 773 and 861, respectively;
(f) SEQ ID NOs: 774 and 862, respectively;
(g) SEQ ID NOs: 775 and 863, respectively;
(h) SEQ ID NOs: 776 and 864, respectively;
(i) SEQ ID NOs: 777 and 865, respectively;
(j) SEQ ID NOs: 778 and 866, respectively;
(k) SEQ ID NOs: 779 and 867, respectively;
(l) SEQ ID NOs: 780 and 868, respectively;
(m) SEQ ID NOs: 781 and 869, respectively;
(n) SEQ ID NOs: 782 and 870, respectively;
(o) SEQ ID NOs: 783 and 871, respectively;
(p) SEQ ID NOs: 784 and 872, respectively;
(q) SEQ ID NOs: 785 and 873, respectively;
(r) SEQ ID NOs: 786 and 874, respectively;
(s) SEQ ID NOs: 787 and 875, respectively;
(t) SEQ ID NOs: 788 and 876, respectively;
(u) SEQ ID NOs: 789 and 877, respectively;
(v) SEQ ID NOs: 790 and 878, respectively;
(w) SEQ ID NOs: 791 and 879, respectively;
(x) SEQ ID NOs: 792 and 880, respectively;
(y) SEQ ID NOs: 793 and 881, respectively;
(z) SEQ ID NOs: 794 and 882, respectively;
(aa) SEQ ID NOs: 795 and 883, respectively;
(bb) SEQ ID NOs: 796 and 884, respectively;
(cc) SEQ ID NOs: 797 and 885, respectively;
(dd) SEQ ID NOs: 798 and 886, respectively;
(ee) SEQ ID NOs: 799 and 887, respectively;
(ff) SEQ ID NOs: 800 and 888, respectively;
(gg) SEQ ID NOs: 801 and 889, respectively;
(hh) SEQ ID NOs: 802 and 890, respectively;
(ii) SEQ ID NOs: 803 and 891, respectively;
(jj) SEQ ID NOs: 804 and 892, respectively;
(kk) SEQ ID NOs: 805 and 893, respectively;
(ll) SEQ ID NOs: 806 and 894, respectively;
(mm) SEQ ID NOs: 807 and 895, respectively;
(nn) SEQ ID NOs: 808 and 896, respectively;
(oo) SEQ ID NOs: 809 and 897, respectively;
(pp) SEQ ID NOs: 810 and 898, respectively;
(qq) SEQ ID NOs: 811 and 899, respectively;
(rr) SEQ ID NOs: 812 and 900, respectively;
(ss) SEQ ID NOs: 813 and 901, respectively;
(tt) SEQ ID NOs: 814 and 902, respectively;
(uu) SEQ ID NOs: 815 and 903, respectively;
(vv) SEQ ID NOs: 816 and 904, respectively;
(ww) SEQ ID NOs: 817 and 905, respectively;
(xx) SEQ ID NOs: 818 and 906, respectively;
(yy) SEQ ID NOs: 819 and 907, respectively;
(zz) SEQ ID NOs: 820 and 908, respectively;

(aaa) SEQ ID NOs: 821 and 909, respectively;
(bbb) SEQ ID NOs: 822 and 910, respectively;
(ccc) SEQ ID NOs: 823 and 911, respectively;
(ddd) SEQ ID NOs: 824 and 912, respectively;
(eee) SEQ ID NOs: 825 and 913, respectively;
(fff) SEQ ID NOs: 826 and 914, respectively;
(ggg) SEQ ID NOs: 827 and 915, respectively;
(hhh) SEQ ID NOs: 828 and 916, respectively;
(iii) SEQ ID NOs: 829 and 917, respectively;
(jjj) SEQ ID NOs: 830 and 918, respectively;
(kkk) SEQ ID NOs: 831 and 919, respectively;
(lll) SEQ ID NOs: 832 and 920, respectively;
(mmm) SEQ ID NOs: 833 and 921, respectively;
(nnn) SEQ ID NOs: 834 and 922, respectively;
(ooo) SEQ ID NOs: 835 and 923, respectively;
(ppp) SEQ ID NOs: 836 and 924, respectively;
(qqq) SEQ ID NOs: 837 and 925, respectively;
(rrr) SEQ ID NOs: 838 and 926, respectively;
(sss) SEQ ID NOs: 839 and 927, respectively;
(ttt) SEQ ID NOs: 840 and 928, respectively;
(uuu) SEQ ID NOs: 1537 and 929, respectively;
(vvv) SEQ ID NOs: 842 and 930, respectively;
(www) SEQ ID NOs: 843 and 931, respectively;
(xxx) SEQ ID NOs: 844 and 932, respectively;
(yyy) SEQ ID NOs: 845 and 933, respectively;
(zzz) SEQ ID NOs: 846 and 934, respectively;
(aaaa) SEQ ID NOs: 847 and 935, respectively;
(bbbb) SEQ ID NOs: 848 and 936, respectively;
(cccc) SEQ ID NOs: 849 and 937, respectively;
(dddd) SEQ ID NOs: 850 and 938, respectively;
(eeee) SEQ ID NOs: 851 and 939, respectively;
(ffff) SEQ ID NOs: 852 and 940, respectively;
(gggg) SEQ ID NOs: 853 and 941, respectively;
(hhhh) SEQ ID NOs: 854 and 942, respectively;
(iiii) SEQ ID NOs: 855 and 943, respectively; and,
(jjjj) SEQ ID NOs: 856 and 944, respectively,
wherein the oligonucleotide comprises a targeting ligand conjugated to at least one nucleotide.

In some embodiments, an oligonucleotide comprises at least one nucleotide (e.g., 1, 2, 3, 4, 5, 6, or more nucleotides) conjugated to one or more targeting ligand(s). In some embodiments, the sense and antisense strands of an oligonucleotide comprise nucleotides sequences selected from the group consisting of:
(a) SEQ ID NOs: 786 and 874, respectively;
(b) SEQ ID NOs: 787 and 875, respectively;
(c) SEQ ID NOs: 1537 and 929, respectively, and;
(d) SEQ ID NOs: 813 and 901, respectively,
wherein the oligonucleotide comprises a targeting ligand conjugated to at least one nucleotide.

In some embodiments, the targeting ligand comprises a carbohydrate, amino sugar, cholesterol, peptide, polypeptide, protein, or part of a protein (e.g., an antibody or antibody fragment), or lipid. In certain embodiments, the targeting ligand is a carbohydrate comprising at least one GalNAc moiety.

In some embodiments, 1 or more (e.g., 1, 2, 3, 4, 5, or 6) nucleotides of an oligonucleotide provided herein (e.g., an RNAi oligonucleotide) are each conjugated to a separate targeting ligand (e.g., a GalNAc moiety). In some embodiments, 2 to 4 nucleotides of an oligonucleotide are each conjugated to a separate targeting ligand. In some embodiments, targeting ligands are conjugated to 2 to 4 nucleotides at either ends of the sense or antisense strand (e.g., targeting ligands are conjugated to a 2 to 4 nucleotide overhang or extension on the 5' or 3' terminus of the sense or antisense strand) such that the targeting ligands resemble bristles of a toothbrush and the oligonucleotide resembles a toothbrush. For example, an oligonucleotide may comprise a stem-loop at either the 5' or 3' terminus of the sense strand and 1, 2, 3, or 4 nucleotides of the loop of the stem may be individually conjugated to a targeting ligand. In some embodiments, an oligonucleotide provided by the disclosure (e.g., a RNAi oligonucleotide) comprises a stem-loop at the 3' terminus of the sense strand, wherein the loop of the stem-loop comprises a triloop or a tetraloop, and wherein the 3 or 4 nucleotides comprising the triloop or tetraloop, respectively, are individually conjugated to a targeting ligand. In some embodiments, an oligonucleotide provided by the disclosure (e.g., a RNAi oligonucleotide) comprises a stem-loop at the 3' terminus of the sense strand, wherein the loop of the stem-loop comprises a tetraloop, and wherein 3 nucleotides of the tetraloop are individually conjugated to a targeting ligand.

GalNAc is a high affinity carbohydrate ligand for the asialoglycoprotein receptor (ASGPR), which is primarily expressed on the surface of hepatocyte cells and has a major role in binding, internalizing and subsequent clearing circulating glycoproteins that contain terminal galactose or GalNAc residues (asialoglycoproteins). Conjugation (either indirect or direct) of GalNAc moieties to oligonucleotides of the instant disclosure can be used to target these oligonucleotides to the ASGPR expressed on cells. In some embodiments, an oligonucleotide of the instant disclosure (e.g., an RNAi oligonucleotide) is conjugated to at least one or more GalNAc moieties, wherein the GalNAc moieties target the oligonucleotide to an ASGPR expressed on human liver cells (e.g., human hepatocytes). In some embodiments, the GalNAc moiety target the oligonucleotide to the liver.

In some embodiments, an oligonucleotide of the instant disclosure (e.g., an RNAi oligonucleotide) is conjugated directly or indirectly to a monovalent GalNAc moiety. In some embodiments, the oligonucleotide is conjugated directly or indirectly to more than one monovalent GalNAc (i.e., is conjugated to 2, 3, or 4 monovalent GalNAc moieties and is typically conjugated to 3 or 4 monovalent GalNAc moieties). In some embodiments, an oligonucleotide is conjugated to one or more bivalent GalNAc, trivalent GalNAc or tetravalent GalNAc moieties. In some embodiments, a bivalent, trivalent or tetravalent GalNAc moiety is conjugated to an oligonucleotide via a branched linker. In some embodiments, a monovalent GalNAc moiety is conjugated to a first nucleotide and a bivalent, trivalent, or tetravalent GalNAc moiety is conjugated to a second nucleotide via a branched linker.

In some embodiments, one (1) or more (e.g., 1, 2, 3, 4, 5, or 6) nucleotides of an oligonucleotide described herein (e.g., an RNAi oligonucleotide) are each conjugated to a GalNAc moiety. In some embodiments, two (2) to four (4) nucleotides of a tetraloop are each conjugated to a separate GalNAc moiety. In some embodiments, one (1) to three (3) nucleotides of a triloop are each conjugated to a separate GalNAc moiety. In some embodiments, targeting ligands are conjugated to two (2) to four (4) nucleotides at either ends of the sense or antisense strand (e.g., ligands are conjugated to a two (2) to four (4) nucleotide overhang or extension on the 5' or 3' terminus of the sense or antisense strand) such that the GalNAc moieties resemble bristles of a toothbrush and the oligonucleotide resembles a toothbrush. In some embodiments, GalNAc moieties are conjugated to a nucleotide of the sense strand. For example, three (3) or four (4) GalNAc moieties can be conjugated to nucleotides in the tetraloop of the sense strand where each GalNAc moiety is conjugated to one (1) nucleotide.

In some embodiments, an oligonucleotide described herein (e.g., an RNAi oligonucleotide) comprises a tetraloop, wherein the tetraloop (L) is any combination of adenine (A) and guanine (G) nucleotides. In some embodiments, the tetraloop (L) comprises a monovalent GalNAc moiety attached to any one or more guanine (G) nucleotides of the tetraloop via any linker described herein, as depicted below (X=heteroatom) in Chem. formula 2:

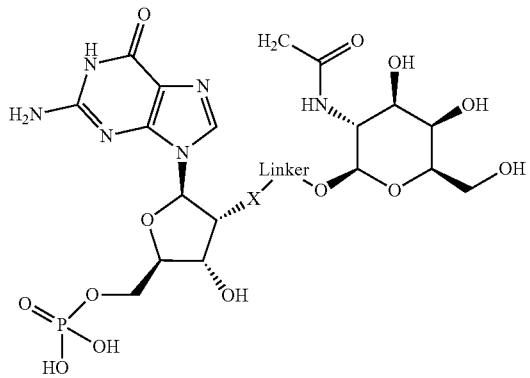

In some embodiments, the tetraloop (L) has a monovalent GalNAc attached to any one or more adenine nucleotides of the tetraloop via any linker described herein, as depicted below (X=heteroatom) in Chem. formula 3:

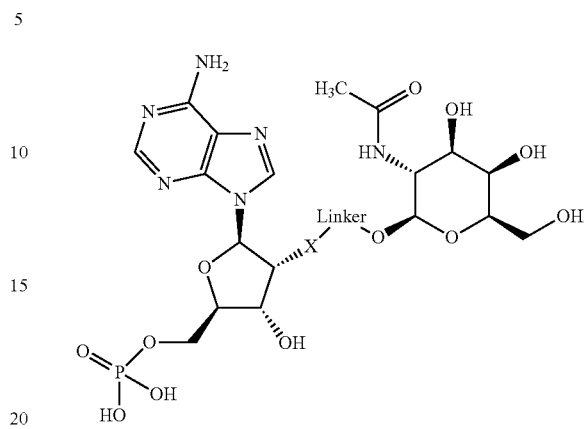

In some embodiments, an oligonucleotide herein (e.g., an RNAi oligonucleotide) comprises a monovalent GalNAc moiety attached to a guanine (G) nucleotide referred to as [ademG-GalNAc] or 2'-aminodiethoxymethanol-Guanine-GalNAc, as depicted below in Chem. formula 4:

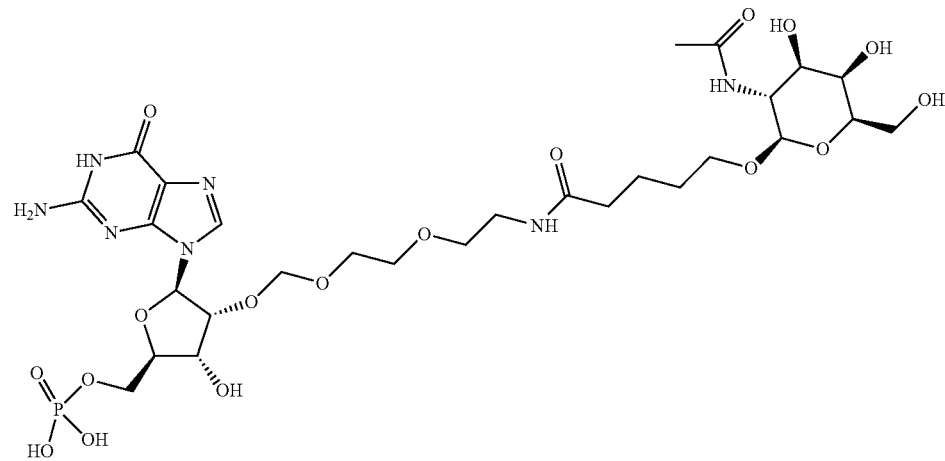 [SMILES: CC(=O)N[C@H]1[C@H](OCCCCC(=O)NCCOCCOCO[C@@H]2[C@H](O)[C@@H](COP(=O)(O)O)O[C@H]2n2cnc3c(=O)[nH]c(N)nc32)O[C@H](CO)[C@H](O)[C@@H]1O]

In some embodiments, an oligonucleotide herein comprises a monovalent GalNAc moiety attached to an adenine nucleotide, referred to as [ademA-GalNAc] or 2'-aminodiethoxymethanol-Adenine-GalNAc, as depicted below Chem. formula 5:

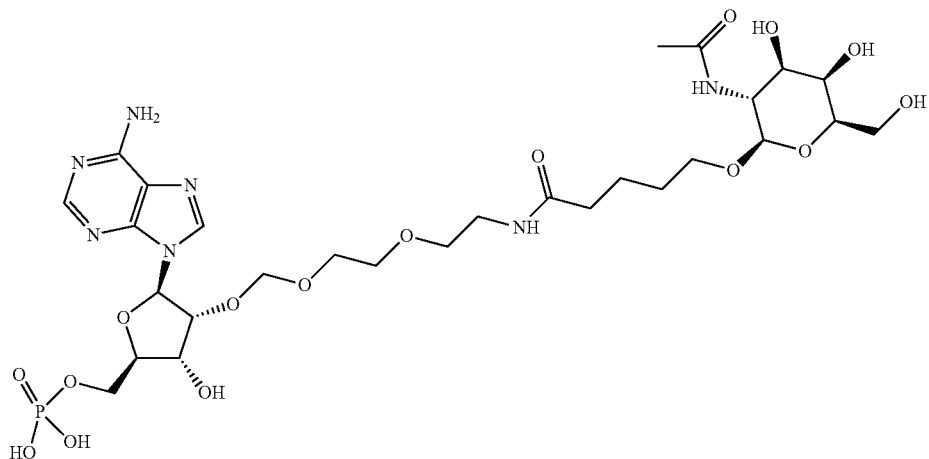 [SMILES: CC(=O)N[C@H]1[C@H](OCCCCC(=O)NCCOCCOCO[C@@H]2[C@H](O)[C@@H](COP(=O)(O)O)O[C@H]2n2cnc3c(N)ncnc32)O[C@H](CO)[C@H](O)[C@@H]1O]
An example of such conjugation is shown below for a loop comprising from 5' to 3' the nucleotide sequence GAAA (L=linker, X=heteroatom). Such a loop may be present, for example, at positions 27-30 of a sense strand provided herein. In the Chem. formula 6 is used to describe an attachment point to the oligonucleotide strand.
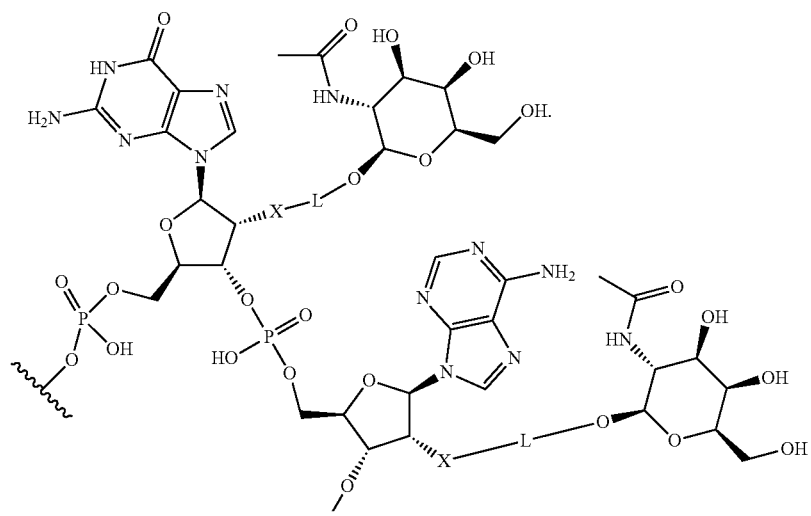

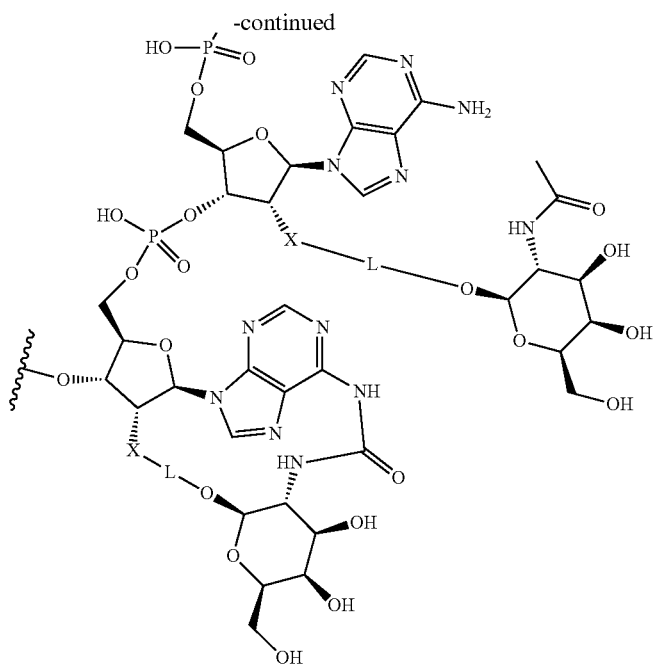

Appropriate methods or chemistry (e.g.; click chemistry) can be used to link a targeting ligand to a nucleotide. In some embodiments, a targeting ligand is conjugated to a nucleotide comprising an oligonucleotide herein (e.g., an RNAi oligonucleotide) using a click linker. In some embodiments, an acetal-based linker is used to conjugate a targeting ligand to a nucleotide of any one of the oligonucleotides described herein. Acetal-based linkers are disclosed, for example, in Intl. Patent Application Publication No. WO2016/100401.

In some embodiments, the linker is a labile linker. However, in other embodiments, the linker is stable. An example is shown below for a loop comprising from 5' to 3' the nucleotides GAAA, in which GalNAc moieties are attached to nucleotides of the loop using an acetal linker. Such a loop may be present, for example, at positions 27-30 of the any one of the sense strands. In the Chem. formula 7 is an attachment point to the oligonucleotide strand.

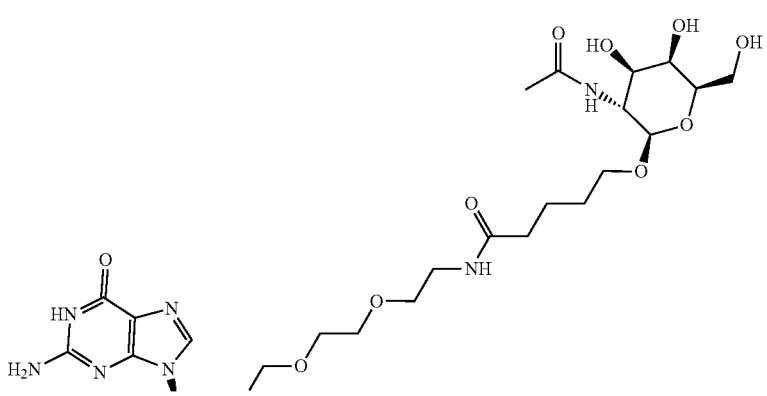

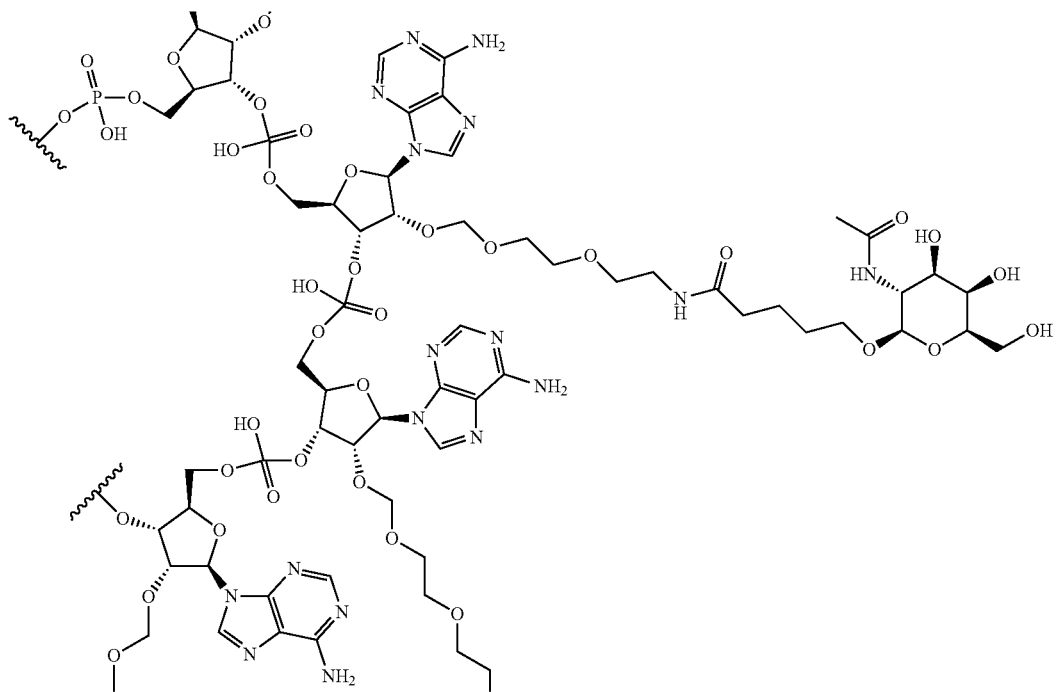
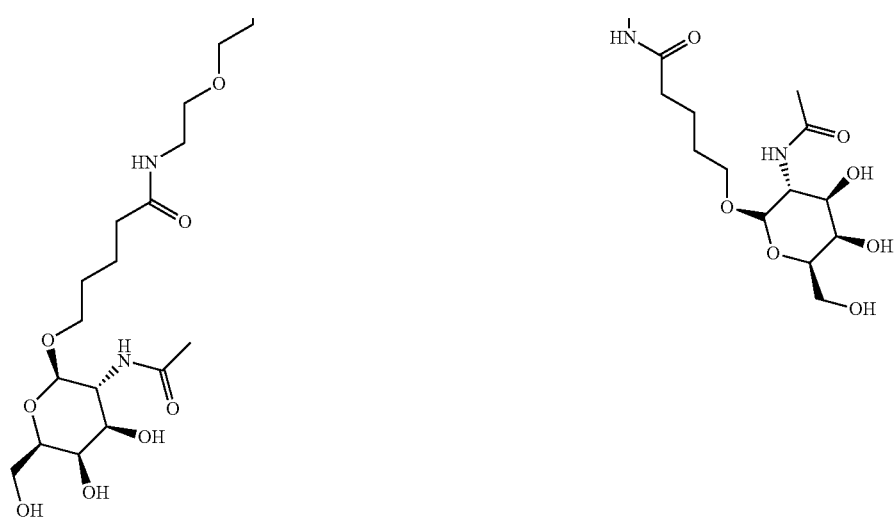

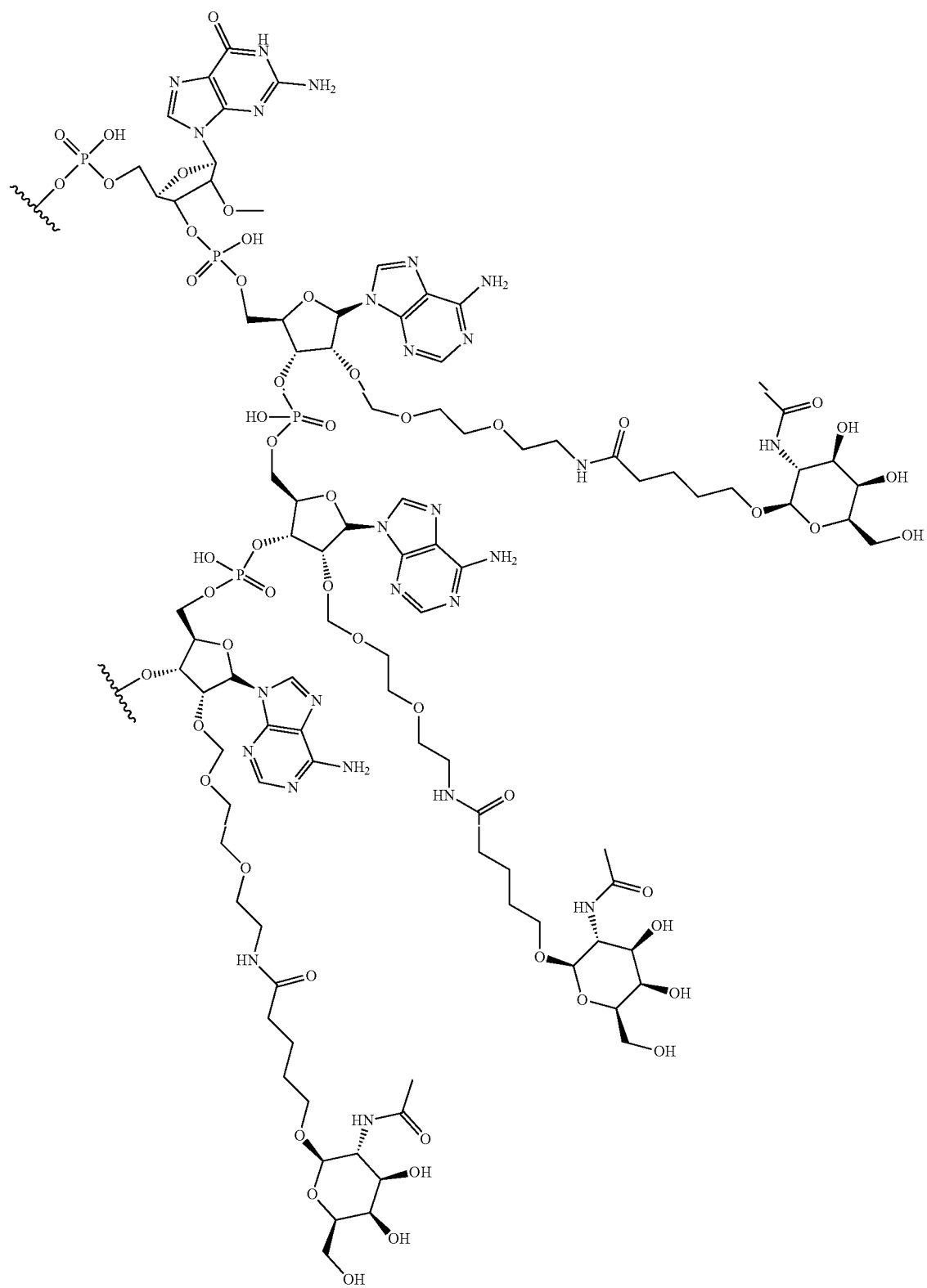

As mentioned, various appropriate methods or chemistry synthetic techniques (e.g., click chemistry) can be used to link a targeting ligand to a nucleotide. In some embodiments, a targeting ligand is conjugated to a nucleotide using a click linker. In some embodiments. an acetal-based linker is used to conjugate a targeting ligand to a nucleotide of any one of the oligonucleotides described herein. Acetal-based linkers are disclosed, for example, in Intl. Patent Application Publication No. WO 2016/100401. In some embodiments, the linker is a labile linker. However, in other embodiments, the linker is a stable linker.

In some embodiments, a duplex extension (e.g., of up to 3, 4, 5, or 6 bp in length) is provided between a targeting ligand (e.g., a GalNAc moiety) and the oligonucleotide. In some embodiments, the oligonucleotides herein (e.g., RNAi oligonucleotides) do not have a GalNAc conjugated thereto.

In some embodiments, the sense and antisense strands of an oligonucleotide comprise nucleotides sequences selected from the group consisting of:

(a) SEQ ID NOs: 769 and 857, respectively;
(b) SEQ ID NOs: 770 and 858, respectively;
(c) SEQ ID NOs: 771 and 859, respectively;
(d) SEQ ID NOs: 772 and 860, respectively;
(e) SEQ ID NOs: 773 and 861, respectively;
(f) SEQ ID NOs: 774 and 862, respectively;
(g) SEQ ID NOs: 775 and 863, respectively;
(h) SEQ ID NOs: 776 and 864, respectively;
(i) SEQ ID NOs: 777 and 865, respectively;
(j) SEQ ID NOs: 778 and 866, respectively;
(k) SEQ ID NOs: 779 and 867, respectively;
(l) SEQ ID NOs: 780 and 868, respectively;
(m) SEQ ID NOs: 781 and 869, respectively;
(n) SEQ ID NOs: 782 and 870, respectively;
(o) SEQ ID NOs: 783 and 871, respectively;
(p) SEQ ID NOs: 784 and 872, respectively;
(q) SEQ ID NOs: 785 and 873, respectively;
(r) SEQ ID NOs: 786 and 874, respectively;
(s) SEQ ID NOs: 787 and 875, respectively;
(t) SEQ ID NOs: 788 and 876, respectively;
(u) SEQ ID NOs: 789 and 877, respectively;
(v) SEQ ID NOs: 790 and 878, respectively;
(w) SEQ ID NOs: 791 and 879, respectively;
(x) SEQ ID NOs: 792 and 880, respectively;
(y) SEQ ID NOs: 793 and 881, respectively;
(z) SEQ ID NOs: 794 and 882, respectively;
(aa) SEQ ID NOs: 795 and 883, respectively;
(bb) SEQ ID NOs: 796 and 884, respectively;
(cc) SEQ ID NOs: 797 and 885, respectively;
(dd) SEQ ID NOs: 798 and 886, respectively;
(ee) SEQ ID NOs: 799 and 887, respectively;
(ff) SEQ ID NOs: 800 and 888, respectively;
(gg) SEQ ID NOs: 801 and 889, respectively;
(hh) SEQ ID NOs: 802 and 890, respectively;
(ii) SEQ ID NOs: 803 and 891, respectively;
(jj) SEQ ID NOs: 804 and 892, respectively;
(kk) SEQ ID NOs: 805 and 893, respectively;
(ll) SEQ ID NOs: 806 and 894, respectively;
(mm) SEQ ID NOs: 807 and 895, respectively;
(nn) SEQ ID NOs: 808 and 896, respectively;
(oo) SEQ ID NOs: 809 and 897, respectively;
(pp) SEQ ID NOs: 810 and 898, respectively;
(qq) SEQ ID NOs: 811 and 899, respectively;
(rr) SEQ ID NOs: 812 and 900, respectively;
(ss) SEQ ID NOs: 813 and 901, respectively;
(tt) SEQ ID NOs: 814 and 902, respectively;
(uu) SEQ ID NOs: 815 and 903, respectively;
(vv) SEQ ID NOs: 816 and 904, respectively;
(ww) SEQ ID NOs: 817 and 905, respectively;
(xx) SEQ ID NOs: 818 and 906, respectively;
(yy) SEQ ID NOs: 819 and 907, respectively;
(zz) SEQ ID NOs: 820 and 908, respectively;
(aaa) SEQ ID NOs: 821 and 909, respectively;
(bbb) SEQ ID NOs: 822 and 910, respectively;
(ccc) SEQ ID NOs: 823 and 911, respectively;
(ddd) SEQ ID NOs: 824 and 912, respectively;
(eee) SEQ ID NOs: 825 and 913, respectively;
(fff) SEQ ID NOs: 826 and 914, respectively;
(ggg) SEQ ID NOs: 827 and 915, respectively;
(hhh) SEQ ID NOs: 828 and 916, respectively;
(iii) SEQ ID NOs: 829 and 917, respectively;
(jjj) SEQ ID NOs: 830 and 918, respectively;
(kkk) SEQ ID NOs: 831 and 919, respectively;
(lll) SEQ ID NOs: 832 and 920, respectively;
(mmm) SEQ ID NOs: 833 and 921, respectively;
(nnn) SEQ ID NOs: 834 and 922, respectively;
(ooo) SEQ ID NOs: 835 and 923, respectively;
(ppp) SEQ ID NOs: 836 and 924, respectively;
(qqq) SEQ ID NOs: 837 and 925, respectively;
(rrr) SEQ ID NOs: 838 and 926, respectively;
(sss) SEQ ID NOs: 839 and 927, respectively;
(ttt) SEQ ID NOs: 840 and 928, respectively;
(uuu) SEQ ID NOs: 1537 and 929, respectively;
(vvv) SEQ ID NOs: 842 and 930, respectively;
(www) SEQ ID NOs: 843 and 931, respectively;
(xxx) SEQ ID NOs: 844 and 932, respectively;
(yyy) SEQ ID NOs: 845 and 933, respectively;
(zzz) SEQ ID NOs: 846 and 934, respectively;
(aaaa) SEQ ID NOs: 847 and 935, respectively;
(bbbb) SEQ ID NOs: 848 and 936, respectively;
(cccc) SEQ ID NOs: 849 and 937, respectively;
(dddd) SEQ ID NOs: 850 and 938, respectively;
(eeee) SEQ ID NOs: 851 and 939, respectively;
(ffff) SEQ ID NOs: 852 and 940, respectively;
(gggg) SEQ ID NOs: 853 and 941, respectively;
(hhhh) SEQ ID NOs: 854 and 942, respectively;
(iiii) SEQ ID NOs: 855 and 943, respectively; and,
(jjjj) SEQ ID NOs: 856 and 944, respectively,
wherein the oligonucleotide comprises at least one GalNAc moiety conjugated to a nucleotide.

In some embodiments, the sense and antisense strands of an oligonucleotide comprise nucleotides sequences selected from the group consisting of:

(a) SEQ ID NOs: 786 and 874, respectively;
(b) SEQ ID NOs: 787 and 875, respectively;
(c) SEQ ID NOs: 1537 and 929, respectively; and,
(d) SEQ ID NOs: 813 and 901, respectively,
wherein the oligonucleotide comprises at least one GalNAc moiety conjugated to a nucleotide.

Exemplary Oligonucleotides for Reducing NR1H3 Expression

In some embodiments, the NR1H3-targeting dsRNAi oligonucleotide for reducing NR1H3 expression provided by the disclosure comprise a sense strand and an antisense strand, wherein all nucleotides comprising the sense strand and antisense strand are modified, wherein the antisense strand comprises a region of complementarity to a NR1H3 mRNA target sequence of any one of SEQ ID NOs: 1-384, and wherein the region of complementarity is at least 15 contiguous nucleotides in length. In some embodiments, the 5'-terminal nucleotide of the antisense strand comprises 5'-methoxyphosphonate-4'-oxy-2'-O-methyluridine [Me-Phosphonate-4O-mU], as described herein. In some embodiments, the 5'-terminal nucleotide of the antisense strand comprises a phosphorothioate linkage. In some embodiments, the antisense strand and the sense strand comprise one or more 2'-fluoro (2'-F) and 2'-O-methyl (2'-OMe) modified nucleotides and at least one phosphorothioate linkage. In some embodiments, the antisense strand comprises four (4) phosphorothioate linkages and the sense strand comprises one (1) phosphorothioate linkage. In some embodiments, the antisense strand comprises five (5) phosphorothioate linkages and the sense strand comprises one (1) phosphorothioate linkage.

In some embodiments, an oligonucleotide provided herein (e.g., an RNAi oligonucleotide) comprises a sense strand having a sequence of any one of SEQ ID NOs: 1-384 and an antisense strand comprising a complementary sequence selected from SEQ ID NOs: 385-768.

In some embodiments, an oligonucleotide provided herein (e.g., an RNAi oligonucleotide) comprises a sense strand having a sequence of any one of SEQ ID NOs: 769-856 and an antisense strand comprising a complementary sequence selected from SEQ ID NOs: 857-944.

In some embodiments, an oligonucleotide provided herein (e.g., an RNAi oligonucleotide) comprises a sense strand having a sequence of any one of SEQ ID NOs: 1519-1552 and an antisense strand comprising a complementary sequence selected from SEQ ID NOs: 857-944.

In some embodiments, an oligonucleotide provided herein (e.g., an RNAi oligonucleotide) comprises a sense strand having a sequence of any one of SEQ ID NOs: 945-1032 and an antisense strand comprising a complementary sequence selected from SEQ ID NOs: 1033-1120.

In some embodiments, an oligonucleotide provided herein (e.g., and RNAi oligonucleotide) for reducing NR1H3 expression comprises:

a sense strand comprising a 2'-F modified nucleotide at positions 8-11, a 2'-OMe modified nucleotide at positions 1-7, 12-27, and 31-36, a GalNAc-conjugated nucleotide at position 28, 29 and 30; and a phosphorothioate linkage between positions 1 and 2;

an antisense strand comprising a 2'-F modified nucleotide at positions 2, 3, 4, 5, 7, 10 and 14, a 2'-OMe at positions 1, 6, 8, 9, 11-13, and 15-22, a phosphorothioate linkage between positions 1 and 2, positions 2 and 3, positions 3 and 4, positions 20 and 21, and positions 21 and 22, and a 5'-terminal nucleotide at position 1 comprising a 4'-phosphate analog, optionally wherein the 5'-terminal nucleotide comprises 5'-methoxyphosphonate-4'-oxy-2'-O-methyluridine [MePhosphonate-4O-mU]; wherein positions 1-20 of the antisense strand form a duplex region with positions 1-20 of the sense strand, wherein positions 21-36 of the sense strand form a stem-loop, wherein positions 27-30 form the loop of the stem-loop, optionally wherein positions 27-30 comprise a tetraloop, wherein positions 21 and 22 of the antisense strand comprise an overhang, and wherein the sense strand and antisense strands comprise nucleotide sequences selected from the group consisting of:

(a) SEQ ID NOs: 769 and 857, respectively;
(b) SEQ ID NOs: 770 and 858, respectively;
(c) SEQ ID NOs: 771 and 859, respectively;
(d) SEQ ID NOs: 772 and 860, respectively;
(e) SEQ ID NOs: 773 and 861, respectively;
(f) SEQ ID NOs: 774 and 862, respectively;
(g) SEQ ID NOs: 775 and 863, respectively;
(h) SEQ ID NOs: 776 and 864, respectively;
(i) SEQ ID NOs: 777 and 865, respectively;
(j) SEQ ID NOs: 778 and 866, respectively;
(k) SEQ ID NOs: 779 and 867, respectively;
(l) SEQ ID NOs: 780 and 868, respectively;
(m) SEQ ID NOs: 781 and 869, respectively;
(n) SEQ ID NOs: 782 and 870, respectively;
(o) SEQ ID NOs: 783 and 871, respectively;
(p) SEQ ID NOs: 784 and 872, respectively;
(q) SEQ ID NOs: 785 and 873, respectively;
(r) SEQ ID NOs: 786 and 874, respectively;
(s) SEQ ID NOs: 787 and 875, respectively;
(t) SEQ ID NOs: 788 and 876, respectively;
(u) SEQ ID NOs: 789 and 877, respectively;
(v) SEQ ID NOs: 790 and 878, respectively;
(w) SEQ ID NOs: 791 and 879, respectively;
(x) SEQ ID NOs: 792 and 880, respectively;
(y) SEQ ID NOs: 793 and 881, respectively;
(z) SEQ ID NOs: 794 and 882, respectively;
(aa) SEQ ID NOs: 795 and 883, respectively;
(bb) SEQ ID NOs: 796 and 884, respectively;
(cc) SEQ ID NOs: 797 and 885, respectively;
(dd) SEQ ID NOs: 798 and 886, respectively;
(ee) SEQ ID NOs: 799 and 887, respectively;
(ff) SEQ ID NOs: 800 and 888, respectively;
(gg) SEQ ID NOs: 801 and 889, respectively;
(hh) SEQ ID NOs: 802 and 890, respectively;
(ii) SEQ ID NOs: 803 and 891, respectively;
(jj) SEQ ID NOs: 804 and 892, respectively;
(kk) SEQ ID NOs: 805 and 893, respectively;
(ll) SEQ ID NOs: 806 and 894, respectively;
(mm) SEQ ID NOs: 807 and 895, respectively;
(nn) SEQ ID NOs: 808 and 896, respectively;
(oo) SEQ ID NOs: 809 and 897, respectively;
(pp) SEQ ID NOs: 810 and 898, respectively;
(qq) SEQ ID NOs: 811 and 899, respectively;
(rr) SEQ ID NOs: 812 and 900, respectively;
(ss) SEQ ID NOs: 813 and 901, respectively;
(tt) SEQ ID NOs: 814 and 902, respectively;
(uu) SEQ ID NOs: 815 and 903, respectively;
(vv) SEQ ID NOs: 816 and 904, respectively;
(ww) SEQ ID NOs: 817 and 905, respectively;
(xx) SEQ ID NOs: 818 and 906, respectively;
(yy) SEQ ID NOs: 819 and 907, respectively;
(zz) SEQ ID NOs: 820 and 908, respectively;
(aaa) SEQ ID NOs: 821 and 909, respectively;
(bbb) SEQ ID NOs: 822 and 910, respectively;
(ccc) SEQ ID NOs: 823 and 911, respectively;
(ddd) SEQ ID NOs: 824 and 912, respectively;
(eee) SEQ ID NOs: 825 and 913, respectively;
(fff) SEQ ID NOs: 826 and 914, respectively;
(ggg) SEQ ID NOs: 827 and 915, respectively;
(hhh) SEQ ID NOs: 828 and 916, respectively;
(iii) SEQ ID NOs: 829 and 917, respectively;
(jjj) SEQ ID NOs: 830 and 918, respectively;
(kkk) SEQ ID NOs: 831 and 919, respectively;
(lll) SEQ ID NOs: 832 and 920, respectively;
(mmm) SEQ ID NOs: 833 and 921, respectively;
(nnn) SEQ ID NOs: 834 and 922, respectively;
(ooo) SEQ ID NOs: 835 and 923, respectively;
(ppp) SEQ ID NOs: 836 and 924, respectively;
(qqq) SEQ ID NOs: 837 and 925, respectively;
(rrr) SEQ ID NOs: 838 and 926, respectively;
(sss) SEQ ID NOs: 839 and 927, respectively;
(ttt) SEQ ID NOs: 840 and 928, respectively;
(uuu) SEQ ID NOs: 1537 and 929, respectively;
(vvv) SEQ ID NOs: 842 and 930, respectively;
(www) SEQ ID NOs: 843 and 931, respectively;
(xxx) SEQ ID NOs: 844 and 932, respectively;
(yyy) SEQ ID NOs: 845 and 933, respectively;
(zzz) SEQ ID NOs: 846 and 934, respectively;
(aaaa) SEQ ID NOs: 847 and 935, respectively;
(bbbb) SEQ ID NOs: 848 and 936, respectively;
(cccc) SEQ ID NOs: 849 and 937, respectively;
(dddd) SEQ ID NOs: 850 and 938, respectively;
(eeee) SEQ ID NOs: 851 and 939, respectively;
(ffff) SEQ ID NOs: 852 and 940, respectively;
(gggg) SEQ ID NOs: 853 and 941, respectively;
(hhhh) SEQ ID NOs: 854 and 942, respectively;

(iiii) SEQ ID NOs: 855 and 943, respectively; and,
(jjjj) SEQ ID NOs: 856 and 944, respectively, In some embodiments, the NR1H3-targeting dsRNAi oligonucleotides for reducing NR1H3 expression comprise:

a sense strand comprising a 2'-F modified nucleotide at positions 8-11, a 2'-OMe modified nucleotide at positions 1-7, 12-27, and 31-36, a GalNAc-conjugated nucleotide at position 28, 29 and 30; and a phosphorothioate linkage between positions 1 and 2;

an antisense strand comprising a 2'-F modified nucleotide at positions 2, 3, 4, 5, 7, 10 and 14, a 2'-OMe at positions 1, 6, 8, 9, 11-13, and 15-22, a phosphorothioate linkage between positions 1 and 2, positions 2 and 3, positions 3 and 4, positions 20 and 21, and positions 21 and 22, and a 5'-terminal nucleotide at position 1 comprising a 4'-phosphate analog, optionally wherein the 5'-terminal nucleotide comprises 5'-methoxyphosphonate-4'-oxy-2'-O-methyluridine [MePhosphonate-40-mU]; wherein positions 1-20 of the antisense strand form a duplex region with positions 1-20 of the sense strand, wherein positions 21-36 of the sense strand form a stem-loop, wherein positions 27-30 form the loop of the stem-loop, optionally wherein positions 27-30 comprise a tetraloop, wherein positions 21 and 22 of the antisense strand comprise an overhang, and wherein the sense strand and antisense strands comprise nucleotide sequences selected from the group consisting of:
(a) SEQ ID NOs: 786 and 874, respectively;
(b) SEQ ID NOs: 787 and 875, respectively;
(c) SEQ ID NOs: 1537 and 929, respectively; and,
(d) SEQ ID NOs: 813 and 901, respectively.

In some embodiments, a NR1H3-targeting oligonucleotide for reducing NR1H3 expression provided by the disclosure comprises a sense strand comprising the nucleotide sequence as set forth in SEQ ID NO: 786 and an antisense strand comprising the nucleotide sequence as set forth in SEQ ID NO: 874. In some embodiments, a NR1H3-targeting oligonucleotide for reducing NR1H3 expression provided by the disclosure comprises a sense strand comprising the nucleotide sequence as set forth in SEQ ID NO: 787 and an antisense strand comprising the nucleotide sequence as set forth in SEQ ID NO: 875. In some embodiments, a NR1H3-targeting oligonucleotide for reducing NR1H3 expression provided by the disclosure comprises a sense strand comprising the nucleotide sequence as set forth in SEQ ID NO: 1537 and an antisense strand comprising the nucleotide sequence as set forth in SEQ ID NO: 929. In some embodiments, a NR1H3-targeting oligonucleotide for reducing NR1H3 expression provided by the disclosure comprises a sense strand comprising the nucleotide sequence as set forth in SEQ ID NO: 813 and an antisense strand comprising the nucleotide sequence as set forth in SEQ ID NO: 901.

In some embodiments, a NR1H3-targeting dsRNAi oligonucleotide for reducing NR1H3 expression comprises (i) an antisense strand of 19-30 nucleotides in length, wherein the antisense strand comprises a nucleotide sequence comprising a region of complementarity to a NR1H3 mRNA target sequence, wherein the region of complementarity is set forth in SEQ ID NO: 1512; and (ii) a sense strand of 19-50 nucleotides in length comprising a region of complementarity to the antisense strand, wherein the antisense and sense strands are separate strands which form an asymmetric duplex region having an overhang of 1-4 nucleotides at the 3' terminus of the antisense strand.

In some embodiments, a NR1H3-targeting dsRNAi oligonucleotide for reducing NR1H3 expression comprises (i) an antisense strand of 19-30 nucleotides in length, wherein the antisense strand comprises a nucleotide sequence comprising a region of complementarity to a NR1H3 mRNA target sequence, wherein the region of complementarity is set forth in SEQ ID NO: 1513; and (ii) a sense strand of 19-50 nucleotides in length comprising a region of complementarity to the antisense strand, wherein the antisense and sense strands are separate strands which form an asymmetric duplex region having an overhang of 1-4 nucleotides at the 3' terminus of the antisense strand.

In some embodiments, a NR1H3-targeting dsRNAi oligonucleotide for reducing NR1H3 expression comprises (i) an antisense strand of 19-30 nucleotides in length, wherein the antisense strand comprises a nucleotide sequence comprising a region of complementarity to a NR1H3 mRNA target sequence, wherein the region of complementarity is set forth in SEQ ID NO: 1514; and (ii) a sense strand of 19-50 nucleotides in length comprising a region of complementarity to the antisense strand, wherein the antisense and sense strands are separate strands which form an asymmetric duplex region having an overhang of 1-4 nucleotides at the 3' terminus of the antisense strand.

In some embodiments, a NR1H3-targeting dsRNAi oligonucleotide for reducing NR1H3 expression comprises (i) an antisense strand of 19-30 nucleotides in length, wherein the antisense strand comprises a nucleotide sequence comprising a region of complementarity to a NR1H3 mRNA target sequence, wherein the region of complementarity is set forth in SEQ ID NO: 1515; and (ii) a sense strand of 19-50 nucleotides in length comprising a region of complementarity to the antisense strand, wherein the antisense and sense strands are separate strands which form an asymmetric duplex region having an overhang of 1-4 nucleotides at the 3' terminus of the antisense strand.

In some embodiments, a NR1H3-targeting dsRNAi oligonucleotide for reducing NR1H3 expression comprises (i) an antisense strand of 19-30 nucleotides in length, wherein the antisense strand comprises a nucleotide sequence comprising a region of complementarity to a NR1H3 mRNA target sequence, wherein the region of complementarity is set forth in SEQ ID NO: 1512; and (ii) a sense strand of 19-50 nucleotides in length comprising a region of complementarity to the antisense strand and a stem-loop at the 3'terminus, wherein the stem-loop is set forth as S1-L-S2, wherein S1 is complementary to S2 and wherein L forms a loop between S1 and S2 of 3 to 5 nucleotides in length, wherein the antisense and sense strands are separate strands which form an asymmetric duplex region having an overhang of 1-4 nucleotides at the 3' terminus of the antisense strand.

In some embodiments, a NR1H3-targeting dsRNAi oligonucleotide for reducing NR1H3 expression comprises (i) an antisense strand of 19-30 nucleotides in length, wherein the antisense strand comprises a nucleotide sequence comprising a region of complementarity to a NR1H3 mRNA target sequence, wherein the region of complementarity is set forth in SEQ ID NO: 1513; and (ii) a sense strand of 19-50 nucleotides in length comprising a region of complementarity to the antisense strand and a stem-loop at the 3'terminus, wherein the stem-loop is set forth as S1-L-S2, wherein S1 is complementary to S2 and wherein L forms a loop between S1 and S2 of 3 to 5 nucleotides in length, wherein the antisense and sense strands are separate strands which form an asymmetric duplex region having an overhang of 1-4 nucleotides at the 3' terminus of the antisense strand.

In some embodiments, a NR1H3-targeting dsRNAi oligonucleotide for reducing NR1H3 expression comprises (i)

an antisense strand of 19-30 nucleotides in length, wherein the antisense strand comprises a nucleotide sequence comprising a region of complementarity to a NR1H3 mRNA target sequence, wherein the region of complementarity is set forth in SEQ ID NO: 1514; and (ii) a sense strand of 19-50 nucleotides in length comprising a region of complementarity to the antisense strand and a stem-loop at the 3'terminus, wherein the stem-loop is set forth as S1-L-S2, wherein S1 is complementary to S2 and wherein L forms a loop between S1 and S2 of 3 to 5 nucleotides in length, wherein the antisense and sense strands are separate strands which form an asymmetric duplex region having an overhang of 1-4 nucleotides at the 3' terminus of the antisense strand.

In some embodiments, a NR1H3-targeting dsRNAi oligonucleotide for reducing NR1H3 expression comprises (i) an antisense strand of 19-30 nucleotides in length, wherein the antisense strand comprises a nucleotide sequence comprising a region of complementarity to a NR1H3 mRNA target sequence, wherein the region of complementarity is set forth in SEQ ID NO: 1515; and (ii) a sense strand of 19-50 nucleotides in length comprising a region of complementarity to the antisense strand and a stem-loop at the 3'terminus, wherein the stem-loop is set forth as S1-L-S2, wherein S1 is complementary to S2 and wherein L forms a loop between S1 and S2 of 3 to 5 nucleotides in length, wherein the antisense and sense strands are separate strands which form an asymmetric duplex region having an overhang of 1-4 nucleotides at the 3' terminus of the antisense strand.

In some embodiments, a NR1H3-targeting dsRNAi oligonucleotide for reducing NR1H3 expression comprises (i) an antisense strand of 19-30 nucleotides in length, wherein the antisense strand comprises a nucleotide sequence comprising a region of complementarity to a NR1H3 mRNA target sequence, wherein the region of complementarity is set forth in SEQ ID NO: 1512; and (ii) a sense strand of 19-50 nucleotides in length comprising a region of complementarity to the antisense strand, wherein the region of complementarity to the antisense strand is set forth in SEQ ID NO: 1509, wherein the antisense and sense strands are separate strands which form an asymmetric duplex region having an overhang of 1-4 nucleotides at the 3' terminus of the antisense strand.

In some embodiments, a NR1H3-targeting dsRNAi oligonucleotide for reducing NR1H3 expression comprises (i) an antisense strand of 19-30 nucleotides in length, wherein the antisense strand comprises a nucleotide sequence comprising a region of complementarity to a NR1H3 mRNA target sequence, wherein the region of complementarity is set forth in SEQ ID NO: 1513; and (ii) a sense strand of 19-50 nucleotides in length comprising a region of complementarity to the antisense strand, wherein the region of complementarity to the antisense strand is set forth in SEQ ID NO: 1510, wherein the antisense and sense strands are separate strands which form an asymmetric duplex region having an overhang of 1-4 nucleotides at the 3' terminus of the antisense strand.

In some embodiments, a NR1H3-targeting dsRNAi oligonucleotide for reducing NR1H3 expression comprises (i) an antisense strand of 19-30 nucleotides in length, wherein the antisense strand comprises a nucleotide sequence comprising a region of complementarity to a NR1H3 mRNA target sequence, wherein the region of complementarity is set forth in SEQ ID NO: 1514; and (ii) a sense strand of 19-50 nucleotides in length comprising a region of complementarity to the antisense strand, wherein the region of complementarity to the antisense strand is set forth in SEQ ID NO: 1409, wherein the antisense and sense strands are separate strands which form an asymmetric duplex region having an overhang of 1-4 nucleotides at the 3' terminus of the antisense strand.

In some embodiments, a NR1H3-targeting dsRNAi oligonucleotide for reducing NR1H3 expression comprises (i) an antisense strand of 19-30 nucleotides in length, wherein the antisense strand comprises a nucleotide sequence comprising a region of complementarity to a NR1H3 mRNA target sequence, wherein the region of complementarity is set forth in SEQ ID NO: 1515; and (ii) a sense strand of 19-50 nucleotides in length comprising a region of complementarity to the antisense strand, wherein the region of complementarity to the antisense strand is set forth in SEQ ID NO: 1511, wherein the antisense and sense strands are separate strands which form an asymmetric duplex region having an overhang of 1-4 nucleotides at the 3' terminus of the antisense strand.

In some embodiments, a NR1H3-targeting dsRNAi oligonucleotide for reducing NR1H3 expression comprises (i) an antisense strand of 19-30 nucleotides in length, wherein the antisense strand comprises a nucleotide sequence comprising a region of complementarity to a NR1H3 mRNA target sequence, wherein the region of complementarity is set forth in SEQ ID NO: 1512; and (ii) a sense strand of 19-50 nucleotides in length comprising a region of complementarity to the antisense strand and a stem-loop at the 3'terminus, wherein the region of complementarity to the antisense strand is set forth in SEQ ID NO: 1509, wherein the stem-loop is set forth as S1-L-S2, wherein S1 is complementary to S2 and wherein L forms a loop between S1 and S2 of 3 to 5 nucleotides in length, wherein the antisense and sense strands are separate strands which form an asymmetric duplex region having an overhang of 1-4 nucleotides at the 3' terminus of the antisense strand.

In some embodiments, a NR1H3-targeting dsRNAi oligonucleotide for reducing NR1H3 expression comprises (i) an antisense strand of 19-30 nucleotides in length, wherein the antisense strand comprises a nucleotide sequence comprising a region of complementarity to a NR1H3 mRNA target sequence, wherein the region of complementarity is set forth in SEQ ID NO: 1513; and (ii) a sense strand of 19-50 nucleotides in length comprising a region of complementarity to the antisense strand and a stem-loop at the 3'terminus, wherein the region of complementarity to the antisense strand is set forth in SEQ ID NO: 1510, wherein the stem-loop is set forth as S1-L-S2, wherein S1 is complementary to S2 and wherein L forms a loop between S1 and S2 of 3 to 5 nucleotides in length, wherein the antisense and sense strands are separate strands which form an asymmetric duplex region having an overhang of 1-4 nucleotides at the 3' terminus of the antisense strand.

In some embodiments, a NR1H3-targeting dsRNAi oligonucleotide for reducing NR1H3 expression comprises (i) an antisense strand of 19-30 nucleotides in length, wherein the antisense strand comprises a nucleotide sequence comprising a region of complementarity to a NR1H3 mRNA target sequence, wherein the region of complementarity is set forth in SEQ ID NO: 1514; and (ii) a sense strand of 19-50 nucleotides in length comprising a region of complementarity to the antisense strand and a stem-loop at the 3'terminus, wherein the region of complementarity to the antisense strand is set forth in SEQ ID NO: 1409, wherein the stem-loop is set forth as S1-L-S2, wherein S1 is complementary to S2 and wherein L forms a loop between S1 and S2 of 3 to 5 nucleotides in length, wherein the antisense and sense strands are separate strands which form an asymmetric duplex region having an overhang of 1-4 nucleotides at the 3' terminus of the antisense strand.

In some embodiments, a NR1H3-targeting dsRNAi oligonucleotide for reducing NR1H3 expression comprises (i) an antisense strand of 19-30 nucleotides in length, wherein the antisense strand comprises a nucleotide sequence comprising a region of complementarity to a NR1H3 mRNA target sequence, wherein the region of complementarity is set forth in SEQ ID NO: 1515; and (ii) a sense strand of 19-50 nucleotides in length comprising a region of complementarity to the antisense strand and a stem-loop at the 3'terminus, wherein the region of complementarity to the antisense strand is set forth in SEQ ID NO: 1511, wherein the stem-loop is set forth as S1-L-S2, wherein S1 is complementary to S2 and wherein L forms a loop between S1 and S2 of 3 to 5 nucleotides in length, wherein the antisense and sense strands are separate strands which form an asymmetric duplex region having an overhang of 1-4 nucleotides at the 3' terminus of the antisense strand.

In some embodiments, the disclosure provides an oligonucleotide (e.g., an RNAi oligonucleotide) for reducing NR1H3 expression, wherein the oligonucleotide comprises a sense strand and an antisense strand according to:
Sense Strand: 5'-mX-S-mX-mX-mX-mX-mX-mX-fX-fX-fX-fX-mX-mX-mX-mX-mX-mX-mX-mX-mX-mX-mX-mX-mX-mX-mX-[ademA-GalNAc]-[ademA-GalNAc]-[ademA-GalNAc]-mX-mX-mX-mX-mX-mX-3';
hybridized to:
Antisense Strand: 5'-[MePhosphonate-4O-mX]-S-fX-S-fX-fX-fX-mX-fX-mX-mX-fX-mX-mX-mX-fX-mX-mX-mX-mX-mX-mX-S-mX-S-mX-3';
wherein mX=2'-O-methyl modified nucleotide, fX=2'-fluoro modified nucleotide, —S—=phosphorothioate linkage, -=phosphodiester linkage, [MePhosphonate-4O-mX]=5'-methoxyphosphonate-4-oxy modified nucleotide, and ademA-GalNAc=GalNAc attached to an adenine nucleotide.

In some embodiments, the disclosure provides an oligonucleotide (e.g., an RNAi oligonucleotide) for reducing NR1H3 expression, wherein the oligonucleotide comprises a sense strand and an antisense strand according to:
Sense Strand: 5'-mX-S-mX-mX-mX-mX-mX-mX-fX-fX-fX-fX-mX-mX-mX-mX-mX-mX-mX-mX-mX-mX-mX-mX-mX-mX-mX-[ademA-GalNAc]-[ademA-GalNAc]-[ademA-GalNAc]-mX-mX-mX-mX-mX-mX-3';
hybridized to:
Antisense Strand: 5'-[MePhosphonate-4O-mX]-S-fX-S-fX-S-fX-fX-mX-fX-mX-mX-fX-mX-mX-mX-fX-mX-mX-mX-mX-mX-mX-S-mX-S-mX-3';
wherein mX=2'-O-methyl modified nucleotide, fX=2'-fluoro modified nucleotide, —S—=phosphorothioate linkage, -=phosphodiester linkage, [MePhosphonate-4O-mX]=5'-methoxyphosphonate-4-oxy modified nucleotide, and ademA-GalNAc=GalNAc attached to an adenine nucleotide.

In some embodiments, the disclosure provides an oligonucleotide (e.g., an RNAi oligonucleotide) for reducing NR1H3 expression, wherein the oligonucleotide comprises a sense strand and an antisense strand comprising nucleotide sequences selected from the group consisting of:
(a) SEQ ID NOs: 945 and 1033, respectively;
(b) SEQ ID NOs: 946 and 1034, respectively;
(c) SEQ ID NOs: 947 and 1035, respectively;
(d) SEQ ID NOs: 948 and 1036, respectively;
(e) SEQ ID NOs: 949 and 1037, respectively;
(f) SEQ ID NOs: 950 and 1038, respectively;
(g) SEQ ID NOs: 951 and 1039, respectively;
(h) SEQ ID NOs: 952 and 1040, respectively;
(i) SEQ ID NOs: 953 and 1041, respectively;
(j) SEQ ID NOs: 954 and 1042, respectively;
(k) SEQ ID NOs: 955 and 1043, respectively;
(l) SEQ ID NOs: 956 and 1044 respectively;
(m) SEQ ID NOs: 957 and 1045, respectively;
(n) SEQ ID NOs: 958 and 1046, respectively;
(o) SEQ ID NOs: 959 and 1047, respectively;
(p) SEQ ID NOs: 960 and 1048, respectively;
(q) SEQ ID NOs: 961 and 1049, respectively;
(r) SEQ ID NOs: 962 and 1050, respectively;
(s) SEQ ID NOs: 963 and 1051, respectively;
(t) SEQ ID NOs: 964 and 1052, respectively;
(u) SEQ ID NOs: 965 and 1053, respectively;
(v) SEQ ID NOs: 966 and 1054, respectively;
(w) SEQ ID NOs: 967 and 1055, respectively;
(x) SEQ ID NOs: 968 and 1056, respectively;
(y) SEQ ID NOs: 969 and 1057, respectively;
(z) SEQ ID NOs: 970 and 1058, respectively;
(aa) SEQ ID NOs: 971 and 1059, respectively;
(bb) SEQ ID NOs: 972 and 1060, respectively;
(cc) SEQ ID NOs: 973 and 1061, respectively;
(dd) SEQ ID NOs: 974 and 1062, respectively;
(ee) SEQ ID NOs: 975 and 1063, respectively;
(ff) SEQ ID NOs: 976 and 1064, respectively;
(gg) SEQ ID NOs: 977 and 1065, respectively;
(hh) SEQ ID NOs: 978 and 1066, respectively;
(ii) SEQ ID NOs: 979 and 1067, respectively;
(jj) SEQ ID NOs: 980 and 1068, respectively;
(kk) SEQ ID NOs: 981 and 1069, respectively;
(ll) SEQ ID NOs: 982 and 1070, respectively;
(mm) SEQ ID NOs: 983 and 1071, respectively;
(nn) SEQ ID NOs: 984 and 1072, respectively;
(oo) SEQ ID NOs: 985 and 1073, respectively;
(pp) SEQ ID NOs: 986 and 1074, respectively;
(qq) SEQ ID NOs: 987 and 1075, respectively;
(rr) SEQ ID NOs: 988 and 1076, respectively;
(ss) SEQ ID NOs: 989 and 1077, respectively;
(tt) SEQ ID NOs: 990 and 1078, respectively;
(uu) SEQ ID NOs: 991 and 1079, respectively;
(vv) SEQ ID NOs: 992 and 1080, respectively;
(ww) SEQ ID NOs: 993 and 1081, respectively;
(xx) SEQ ID NOs: 994 and 1082, respectively;
(yy) SEQ ID NOs: 995 and 1083, respectively;
(zz) SEQ ID NOs: 996 and 1084, respectively;
(aaa) SEQ ID NOs: 997 and 1085, respectively;
(bbb) SEQ ID NOs: 998 and 1086, respectively;
(ccc) SEQ ID NOs: 999 and 1087, respectively;
(ddd) SEQ ID NOs: 1000 and 1088, respectively;
(eee) SEQ ID NOs: 1001 and 1089, respectively;
(fff) SEQ ID NOs: 1002 and 1090, respectively;
(ggg) SEQ ID NOs: 1003 and 1091, respectively;
(hhh) SEQ ID NOs: 1004 and 1092 respectively;
(iii) SEQ ID NOs: 1005 and 1093 respectively;
(jjj) SEQ ID NOs: 1006 and 1094, respectively;
(kkk) SEQ ID NOs: 1007 and 1095, respectively;
(lll) SEQ ID NOs: 1008 and 1096, respectively;
(mmm) SEQ ID NOs: 1009 and 1097, respectively;
(nnn) SEQ ID NOs: 1010 and 1098, respectively;
(ooo) SEQ ID NOs: 1011 and 1099, respectively;
(ppp) SEQ ID NOs: 1012 and 1100, respectively;
(qqq) SEQ ID NOs: 1013 and 1101, respectively;
(rrr) SEQ ID NOs: 1014 and 1102, respectively;
(sss) SEQ ID NOs: 1015 and 1103, respectively;
(ttt) SEQ ID NOs: 1016 and 1104, respectively;
(uuu) SEQ ID NOs: 1017 and 1105, respectively;

(vvv) SEQ ID NOs: 1018 and 1106, respectively;
(www) SEQ ID NOs: 1019 and 1107, respectively;
(xxx) SEQ ID NOs: 1020 and 1108, respectively;
(yyy) SEQ ID NOs: 1021 and 1109, respectively;
(zzz) SEQ ID NOs: 1022 and 1110, respectively;
(aaaa) SEQ ID NOs: 1023 and 1111, respectively;
(bbbb) SEQ ID NOs: 1024 and 1112, respectively;
(cccc) SEQ ID NOs: 1025 and 1113, respectively;
(dddd) SEQ ID NOs: 1026 and 1114, respectively;
(eeee) SEQ ID NOs: 1027 and 1115, respectively;
(ffff) SEQ ID NOs: 1028 and 1116, respectively;
(gggg) SEQ ID NOs: 1029 and 1117, respectively;
(hhhh) SEQ ID NOs: 1030 and 1118, respectively;
(iiii) SEQ ID NOs: 1031 and 1119, respectively; and,
(jjjj) SEQ ID NOs: 1032 and 1120, respectively.

In some embodiments, a NR1H3-targeting oligonucleotide for reducing NR1H3 expression provided by the disclosure comprises a sense strand comprising the nucleotide sequence as set forth in SEQ ID NO: 963 and an antisense strand comprising the nucleotide sequence as set forth in SEQ ID NO: 1051. In some embodiments, a NR1H3-targeting oligonucleotide for reducing NR1H3 expression provided by the disclosure comprises a sense strand comprising the nucleotide sequence as set forth in SEQ ID NO: 964 and an antisense strand comprising the nucleotide sequence as set forth in SEQ ID NO: 1052. In some embodiments, a NR1H3-targeting oligonucleotide for reducing NR1H3 expression provided by the disclosure comprises a sense strand comprising the nucleotide sequence as set forth in SEQ ID NO: 1006 and an antisense strand comprising the nucleotide sequence as set forth in SEQ ID NO: 1094. In some embodiments, a NR1H3-targeting oligonucleotide for reducing NR1H3 expression provided by the disclosure comprises a sense strand comprising the nucleotide sequence as set forth in SEQ ID NO: 1018 and an antisense strand comprising the nucleotide sequence as set forth in SEQ ID NO: 1106.

Formulations

Various formulations (e.g., pharmaceutical formulations) have been developed for oligonucleotide use. For example, oligonucleotides (e.g., RNAi oligonucleotides) can be delivered to a subject or a cellular environment using a formulation that minimizes degradation, facilitates delivery and/or uptake, or provides another beneficial property to the oligonucleotides in the formulation. In some embodiments, provided herein are compositions comprising oligonucleotides (e.g., RNAi oligonucleotides) reduce the expression of NR1H3. Such compositions can be suitably formulated such that when administered to a subject, either into the immediate environment of a target cell or systemically, a sufficient portion of the oligonucleotides enter the cell to reduce NR1H3 expression. Any variety of suitable oligonucleotide formulations can be used to deliver oligonucleotides for the reduction of NR1H3 as disclosed herein. In some embodiments, an oligonucleotide is formulated in buffer solutions such as phosphate buffered saline solutions, liposomes, micellar structures, and capsids. Any of the oligonucleotides described herein may be provided not only as nucleic acids, but also in the form of a pharmaceutically acceptable salt.

Formulations of oligonucleotides with cationic lipids can be used to facilitate transfection of the oligonucleotides into cells. For example, cationic lipids, such as lipofectin, cationic glycerol derivatives, and polycationic molecules (e.g., polylysine), can be used. Suitable lipids include Oligofectamine, Lipofectamine (Life Technologies), NC388 (Ribozyme Pharmaceuticals, Inc., Boulder, Colo.), or FuGene 6 (Roche) all of which can be used according to the manufacturer's instructions.

Accordingly, in some embodiments, a formulation comprises a lipid nanoparticle. In some embodiments, an excipient comprises a liposome, a lipid, a lipid complex, a microsphere, a microparticle, a nanosphere or a nanoparticle, or may be otherwise formulated for administration to the cells, tissues, organs, or body of a subject in need thereof (see, e.g., Remington: THE SCIENCE AND PRACTICE OF PHARMACY, 22nd edition, Pharmaceutical Press, 2013).

In some embodiments, the formulations herein comprise an excipient. In some embodiments, an excipient confers to a composition improved stability, improved absorption, improved solubility and/or therapeutic enhancement of the active ingredient. In some embodiments, an excipient is a buffering agent (e.g., sodium citrate, sodium phosphate, a tris base, or sodium hydroxide) or a vehicle (e.g., a buffered solution, petrolatum, dimethyl sulfoxide, or mineral oil). In some embodiments, an oligonucleotide is lyophilized for extending its shelf-life and then made into a solution before use (e.g., administration to a subject). Accordingly, an excipient in a composition comprising any one of the oligonucleotides described herein may be a lyoprotectant (e.g., mannitol, lactose, polyethylene glycol or polyvinylpyrrolidone) or a collapse temperature modifier (e.g., dextran, Ficoll™ or gelatin).

In some embodiments, a pharmaceutical composition is formulated to be compatible with its intended route of administration. The route of administration may be any route which effectively transports a compound of this invention to the desired or appropriate place in the body. Examples of routes of administration include parenteral (e.g., intravenous, intramuscular, intraperitoneal, intradermal, subcutaneous), oral (e.g., inhalation), transdermal (e.g., topical), transmucosal and rectal administration.

Pharmaceutical compositions suitable for injectable use include sterile aqueous solutions (where water soluble) or dispersions and sterile powders for the extemporaneous preparation of sterile injectable solutions or dispersions. For intravenous administration, suitable carriers include physiological saline, bacteriostatic water, Cremophor EL™ (BASF, Parsippany, N.J.) or phosphate buffered saline (PBS). The carrier can be a solvent or dispersion medium containing, for example, water, ethanol, polyol (e.g., glycerol, propylene glycol, and liquid polyethylene glycol, and the like), and suitable mixtures thereof. In many cases, it will be preferable to include isotonic agents, for example, sugars, polyalcohols such as mannitol, sorbitol, sodium chloride in the composition. Sterile injectable solutions can be prepared by incorporating the oligonucleotides in a required amount in a selected solvent with one or a combination of ingredients enumerated above, as required, followed by filtered sterilization.

In some embodiments, a composition may contain at least about 0.1% of the therapeutic agent (e.g., a RNAi oligonucleotide for reducing NR1H3 expression) or more, although the percentage of the active ingredient(s) may be between about 1% to about 80% or more of the weight or volume of the total composition. Factors such as solubility, bioavailability, biological half-life, route of administration, product shelf life, as well as other pharmacological considerations will be contemplated by one skilled in the art of preparing such pharmaceutical formulations, and as such, a variety of dosages and treatment regimens may be desirable.

Methods of Use
Reducing NR1H3 Expression

In some embodiments, the disclosure provides methods for contacting or delivering to a cell or population of cells an effective amount of oligonucleotides provided herein (e.g., RNAi oligonucleotides) to reduce NR1H3 expression. In some embodiments, a reduction of NR1H3 expression is determined by measuring a reduction in the amount or level of NR1H3 mRNA, NR1H3 protein, or NR1H3 activity in a cell. The methods include those described herein and known to one of ordinary skill in the art.

Methods provided herein are useful in any appropriate cell type. In some embodiments, a cell is any cell that expresses NR1H3 mRNA (e.g., hepatocytes). In some embodiments, the cell is a primary cell obtained from a subject. In some embodiments, the primary cell has undergone a limited number of passages such that the cell substantially maintains its natural phenotypic properties. In some embodiments, a cell to which the oligonucleotide is delivered is ex vivo or in vitro (i.e., can be delivered to a cell in culture or to an organism in which the cell resides).

In some embodiments, the oligonucleotides herein (e.g., RNAi oligonucleotides) are delivered to a cell or population of cells using a nucleic acid delivery method known in the art including, but not limited to, injection of a solution containing the oligonucleotides, bombardment by particles covered by the oligonucleotides, exposing the cell or population of cells to a solution containing the oligonucleotides, or electroporation of cell membranes in the presence of the oligonucleotides. Other methods known in the art for delivering oligonucleotides to cells may be used, such as lipid-mediated carrier transport, chemical-mediated transport, and cationic liposome transfection such as calcium phosphate, and others.

In some embodiments, reduction of NR1H3 expression is determined by an assay or technique that evaluates one or more molecules, properties, or characteristics of a cell or population of cells associated with NR1H3 expression, or by an assay or technique that evaluates molecules that are directly indicative of NR1H3 expression in a cell or population of cells (e.g., NR1H3 mRNA or NR1H3 protein). In some embodiments, the extent to which an oligonucleotide provided herein reduces NR1H3 expression is evaluated by comparing NR1H3 expression in a cell or population of cells contacted with the oligonucleotide to an appropriate control (e.g., an appropriate cell or population of cells not contacted with the oligonucleotide or contacted with a control oligonucleotide). In some embodiments, a control amount or level of NR1H3 expression in a control cell or population of cells is predetermined, such that the control amount or level need not be measured in every instance the assay or technique is performed. The predetermined level or value can take a variety of forms. In some embodiments, a predetermined level or value can be single cut-off value, such as a median or mean.

In some embodiments, contacting or delivering an oligonucleotide described herein (e.g., an RNAi oligonucleotide) to a cell or a population of cells results in a reduction in NR1H3 expression in a cell or population of cells not contacted with the oligonucleotide or contacted with a control oligonucleotide. In some embodiments, the reduction in NR1H3 expression is about 1% or lower, about 5% or lower, about 10% or lower, about 15% or lower, about 20% or lower, about 25% or lower, about 30% or lower, about 35% or lower, about 40% or lower, about 45% or lower, about 50% or lower, about 55% or lower, about 60% or lower, about 70% or lower, about 80% or lower, or about 90% or lower relative to a control amount or level of NR1H3 expression. In some embodiments, the control amount or level of NR1H3 expression is an amount or level of NR1H3 mRNA and/or NR1H3 protein in a cell or population of cells that has not been contacted with an oligonucleotide herein. In some embodiments, the effect of delivery of an oligonucleotide herein to a cell or population of cells according to a method herein is assessed after any finite period or amount of time (e.g., minutes, hours, days, weeks, months). For example, in some embodiments, NR1H3 expression is determined in a cell or population of cells at least about 4 hours, about 8 hours, about 12 hours, about 18 hours, about 24 hours; or at least about 1 day, about 2 days, about 3 days, about 4 days, about 5 days, about 6 days, about 7 days, about 8 days, about 9 days, about 10 days, about 11 days, about 12 days, about 13 days, about 14 days, about 21 days, about 28 days, about 35 days, about 42 days, about 49 days, about 56 days, about 63 days, about 70 days, about 77 days, or about 84 days or more after contacting or delivering the oligonucleotide to the cell or population of cells. In some embodiments, NR1H3 expression is determined in a cell or population of cells at least about 1 month, about 2 months, about 3 months, about 4 months, about 5 months, or about 6 months or more after contacting or delivering the oligonucleotide to the cell or population of cells.

In some embodiments, an oligonucleotide provided herein (e.g., an RNAi oligonucleotide) is delivered in the form of a transgene that is engineered to express in a cell the oligonucleotide or strands comprising the oligonucleotide (e.g., its sense and antisense strands). In some embodiments, an oligonucleotide herein is delivered using a transgene engineered to express any oligonucleotide disclosed herein. Transgenes may be delivered using viral vectors (e.g., adenovirus, retrovirus, vaccinia virus, poxvirus, adeno-associated virus, or herpes simplex virus) or non-viral vectors (e.g., plasmids or synthetic mRNAs). In some embodiments, transgenes can be injected directly to a subject.

Treatment Methods

The disclosure provides oligonucleotides (e.g., RNAi oligonucleotides) for use as a medicament, in particular for use in a method for the treatment of diseases, disorders, and conditions associated with expression of NR1H3. The disclosure also provides oligonucleotides for use, or adaptable for use, to treat a subject (e.g., a human having a disease, disorder or condition associated with NR1H3 expression) that would benefit from reducing NR1H3 expression. In some respects, the disclosure provides oligonucleotides for use, or adapted for use, to treat a subject having a disease, disorder or condition associated with expression of NR1H3. The disclosure also provides oligonucleotides for use, or adaptable for use, in the manufacture of a medicament or pharmaceutical composition for treating a disease, disorder or condition associated with NR1H3 expression. In some embodiments, the oligonucleotides for use, or adaptable for use, target NR1H3 mRNA and reduce NR1H3 expression (e.g., via the RNAi pathway). In some embodiments, the oligonucleotides for use, or adaptable for use, target NR1H3 mRNA and reduce the amount or level of NR1H3 mRNA, NR1H3 protein and/or NR1H3 activity.

In addition, in some embodiments of the methods herein, a subject having a disease, disorder, or condition associated with NR1H3 expression or is predisposed to the same is selected for treatment with an oligonucleotide provided herein (e.g., an RNAi oligonucleotide). In some embodiments, the method comprises selecting an individual having a marker (e.g., a biomarker) for a disease, disorder, or condition associated with NR1H3 expression or predisposed to the same, such as, but not limited to, NR1H3 mRNA, NR1H3 protein, or a combination thereof. Likewise, and as detailed below, some embodiments of the methods provided by the disclosure include steps such as measuring or obtaining a baseline value for a marker of NR1H3 expression (e.g., NR1H3 mRNA), and then comparing such obtained value to one or more other baseline values or values obtained after the subject is administered the oligonucleotide to assess the effectiveness of treatment.

The disclosure also provides methods of treating a subject having, suspected of having, or at risk of developing a disease, disorder or condition associated with a NR1H3 expression with an oligonucleotide provided herein. In some respects, the current disclosure provides methods of treating or attenuating the onset or progression of a disease, disorder or condition associated with NR1H3 expression using the oligonucleotides herein. In other aspects, the disclosure provides methods to achieve one or more therapeutic benefits in a subject having a disease, disorder, or condition associated with NR1H3 expression using the oligonucleotides provided herein. In some embodiments of the methods herein, the subject is treated by administering a therapeutically effective amount of any one or more of the oligonucleotides provided herein. In some embodiments, treatment comprises reducing NR1H3 expression. In some embodiments, the subject is treated therapeutically. In some embodiments, the subject is treated prophylactically.

In some embodiments of the methods herein, one or more oligonucleotides herein (e.g., RNAi oligonucleotides), or a pharmaceutical composition comprising one or more oligonucleotides, is administered to a subject having a disease, disorder or condition associated with NR1H3 expression such that NR1H3 expression is reduced in the subject, thereby treating the subject. In some embodiments, an amount or level of NR1H3 mRNA is reduced in the subject. In some embodiments, an amount or level of NR1H3 protein is reduced in the subject. In some embodiments, an amount or level of NR1H3 activity is reduced in the subject.

In some embodiments of the methods herein, an oligonucleotide provided herein (e.g., an RNAi oligonucleotide), or a pharmaceutical composition comprising the oligonucleotide, is administered to a subject having a disease, disorder or condition associated with NR1H3 such that NR1H3 expression is reduced in the subject by at least about 30%, about 35%, about 40%, about 45%, about 50%, about 55%, about 60%, about 65%, about 70%, about 75%, about 80%, about 85%, about 90%, about 95%, about 99%, or greater than 99% when compared to NR1H3 expression prior to administration of one or more oligonucleotides or pharmaceutical composition. In some embodiments, NR1H3 expression is reduced in the subject by at least about 30%, about 35%, about 40%, about 45%, about 50%, about 55%, about 60%, about 65%, about 70%, about 75%, about 80%, about 85%, about 90%, about 95%, about 99%, or greater than 99% when compared to NR1H3 expression in a subject (e.g., a reference or control subject) not receiving the oligonucleotide or oligonucleotides or pharmaceutical composition or receiving a control oligonucleotide or oligonucleotides, pharmaceutical composition or treatment.

In some embodiments of the methods herein, an oligonucleotide or oligonucleotides herein (e.g., RNAi oligonucleotides), or a pharmaceutical composition comprising the oligonucleotide or oligonucleotides, is administered to a subject having a disease, disorder or condition associated with NR1H3 expression such that an amount or level of NR1H3 mRNA is reduced in the subject by at least about 30%, about 35%, about 40%, about 45%, about 50%, about 55%, about 60%, about 65%, about 70%, about 75%, about 80%, about 85%, about 90%, about 95%, about 99%, or greater than 99% when compared to the amount or level of NR1H3 mRNA prior to administration of the oligonucleotide or pharmaceutical composition. In some embodiments, an amount or level of NR1H3 mRNA is reduced in the subject by at least about 30%, about 35%, about 40%, about 45%, about 50%, about 55%, about 60%, about 65%, about 70%, about 75%, about 80%, about 85%, about 90%, about 95%, about 99%, or greater than 99% when compared to an amount or level of NR1H3 mRNA in a subject (e.g., a reference or control subject) not receiving the oligonucleotide or oligonucleotides or pharmaceutical composition or receiving a control oligonucleotide or oligonucleotides, pharmaceutical composition or treatment.

In some embodiments of the methods herein, an oligonucleotide or oligonucleotides herein, or a pharmaceutical composition comprising the oligonucleotide or oligonucleotides, is administered to a subject having a disease, disorder or condition associated with NR1H3 expression such that an amount or level of NR1H3 protein is reduced in the subject by at least about 30%, about 35%, about 40%, about 45%, about 50%, about 55%, about 60%, about 65%, about 70%, about 75%, about 80%, about 85%, about 90%, about 95%, about 99% or greater than 99% when compared to the amount or level of NR1H3 protein prior to administration of the oligonucleotide or pharmaceutical composition. In some embodiments, an amount or level of NR1H3 protein is reduced in the subject by at least about 30%, about 35%, about 40%, about 45%, about 50%, about 55%, about 60%, about 65%, about 70%, about 75%, about 80%, about 85%, about 90%, about 95%, about 99%, or greater than 99% when compared to an amount or level of NR1H3 protein in a subject (e.g., a reference or control subject) not receiving the oligonucleotide or oligonucleotides or pharmaceutical composition or receiving a control oligonucleotide, oligonucleotides or pharmaceutical composition or treatment.

In some embodiments of the methods herein, an oligonucleotide or oligonucleotides (e.g., RNAi oligonucleotides) herein, or a pharmaceutical composition comprising the oligonucleotide or oligonucleotides, is administered to a subject having a disease, disorder or condition associated with NR1H3 such that an amount or level of NR1H3 gene activity/expression is reduced in the subject by at least about 30%, about 35%, about 40%, about 45%, about 50%, about 55%, about 60%, about 65%, about 70%, about 75%, about 80%, about 85%, about 90%, about 95%, about 99%, or greater than 99% when compared to the amount or level of NR1H3 activity prior to administration of the oligonucleotide or pharmaceutical composition. In some embodiments, an amount or level of NR1H3 activity is reduced in the subject by at least about 30%, about 35%, about 40%, about 45%, about 50%, about 55%, about 60%, about 65%, about 70%, about 75%, about 80%, about 85%, about 90%, about 95%, about 99%, or greater than 99% when compared to an amount or level of NR1H3 activity in a subject (e.g., a reference or control subject) not receiving the oligonucleotide or pharmaceutical composition or receiving a control oligonucleotide, pharmaceutical composition or treatment.

Suitable methods for determining NR1H3 expression, the amount or level of NR1H3 mRNA, NR1H3 protein, NR1H3 activity, or a biomarker related to or affected by modulation of NR1H3 expression (e.g., a plasma biomarker), in the subject, or in a sample from the subject, are known in the art. Further, the Examples set forth herein illustrate methods for determining NR1H3 expression.

In some embodiments, NR1H3 expression, the amount or level of NR1H3 mRNA, NR1H3 protein, NR1H3 activity, or a biomarker related to or affected by modulation of NR1H3 expression, or any combination thereof, is reduced in a cell (e.g., a hepatocyte), a population or a group of cells (e.g., an organoid), an organ (e.g., liver), blood or a fraction thereof (e.g., plasma), a tissue (e.g., liver tissue), a sample (e.g., a liver biopsy sample), or any other appropriate biological material obtained or isolated from the subject. In some embodiments, NR1H3 expression, the amount or level of NR1H3 mRNA, NR1H3 protein, NR1H3 activity, or a biomarker related to or affected by modulation of NR1H3 expression, or any combination thereof, is reduced in more than one type of cell (e.g., a hepatocyte and one or more other type(s) of cell), more than one groups of cells, more than one organ (e.g., liver and one or more other organ(s)), more than one fraction of blood (e.g., plasma and one or more other blood fraction(s)), more than one type of tissue (e.g., liver tissue and one or more other type(s) of tissue), or more than one type of sample (e.g., a liver biopsy sample and one or more other type(s) of biopsy sample).

Because of their high specificity, the oligonucleotides provided herein (e.g., dsRNAi oligonucleotides) specifically target mRNA of target genes (e.g., NR1H3 mRNA) of cells and tissue(s), or organs(s) (e.g., liver). In preventing disease, the target gene may be one which is required for initiation or maintenance of the disease or which has been identified as being associated with a higher risk of contracting the disease. In treating disease, the oligonucleotide can be brought into contact with the cells, tissue(s), or organ(s) (e.g., liver) exhibiting or responsible for mediating the disease. For example, an oligonucleotide (e.g., an RNAi oligonucleotide) substantially identical to all or part of a wild-type (i.e., native) or mutated gene associated with a disorder or condition associated with NR1H3 expression may be brought into contact with or introduced into a cell or tissue type of interest such as a hepatocyte or other liver cell.

In some embodiments, the target gene may be a target gene from any mammal, such as a human target. Any target gene may be silenced according to the method described herein.

Methods described herein typically involve administering to a subject an effective amount of an oligonucleotide herein (e.g., a RNAi oligonucleotide), that is, an amount that produces or generates a desirable therapeutic result. A therapeutically acceptable amount may be an amount that therapeutically treats a disease or disorder. The appropriate dosage for any one subject will depend on certain factors, including the subject's size, body surface area, age, the composition to be administered, the active ingredient(s) in the composition, time and route of administration, general health, and other drugs being administered concurrently.

In some embodiments, a subject is administered any one of the compositions herein (e.g., a composition comprising an RNAi oligonucleotide described herein) either enterally (e.g., orally, by gastric feeding tube, by duodenal feeding tube, via gastrostomy or rectally), parenterally (e.g., subcutaneous injection, intravenous injection or infusion, intraarterial injection or infusion, intraosseous infusion, intramuscular injection, intracerebral injection, intracerebroventricular injection, intrathecal), topically (e.g., epicutaneous, inhalational, via eye drops, or through a mucous membrane), or by direct injection into a target organ (e.g., the liver of a subject). Typically, oligonucleotides herein are administered intravenously or subcutaneously.

In some embodiments, an oligonucleotide herein (e.g., an RNAi oligonucleotide), or a pharmaceutical composition comprising the oligonucleotide, is administered alone or in combination. In some embodiments, the oligonucleotides herein are administered in combination concurrently, sequentially (in any order), or intermittently. For example, two oligonucleotides may be co-administered concurrently. Alternatively, one oligonucleotide may be administered and followed any amount of time later (e.g., one hour, one day, one week or one month) by the administration of a second oligonucleotide.

In some embodiments, an oligonucleotide herein (e.g., an RNAi oligonucleotide), or a pharmaceutical composition comprising the oligonucleotide, is administered in combination with one or more additional pharmacologically active substances. In some embodiments the additional pharmacologically active substances are selected from e.g., anti-diabetic agents, anti-obesity agents, appetite regulating agents, antihypertensive agents, agents.

In some embodiments, the subject to be treated is a human or non-human primate or other mammalian subject. Other exemplary subjects include domesticated animals such as dogs and cats; livestock such as horses, cattle, pigs, sheep, goats, and chickens; and animals such as mice, rats, guinea pigs, and hamsters.

Kits

In some embodiments, the disclosure provides a kit comprising an oligonucleotide herein (e.g., an RNAi oligonucleotide), and instructions for use. In some embodiments, the kit comprises an oligonucleotide herein, and a package insert containing instructions for use of the kit and/or any component thereof. In some embodiments, the kit comprises, in a suitable container, an oligonucleotide herein, one or more controls, and various buffers, reagents, enzymes and other standard ingredients well known in the art. In some embodiments, the container comprises at least one vial, well, test tube, flask, bottle, syringe, or other container means, into which the oligonucleotide is placed, and in some instances, suitably aliquoted. In some embodiments where an additional component is provided, the kit contains additional containers into which this component is placed. The kits can also include a means for containing the oligonucleotide and any other reagent in close confinement for commercial sale. Such containers may include injection or blow-molded plastic containers into which the desired vials are retained. Containers and/or kits can include labeling with instructions for use and/or warnings.

In some embodiments, a kit comprises an oligonucleotide herein (e.g., an RNAi oligonucleotide), and a pharmaceutically acceptable carrier, or a pharmaceutical composition comprising the oligonucleotide and instructions for treating or delaying progression of a disease, disorder or condition associated with NR1H3 expression in a subject in need thereof.

Definitions

As used herein, the term "antisense oligonucleotide" encompasses a nucleic acid-based molecule which has a sequence complementary to all or part of the target mRNA, in particular seed sequence thereby capable of forming a duplex with a mRNA. Thus, the term "antisense oligonucleotide", as used herein, may be referred to as "complementary nucleic acid-based inhibitor".

As used herein, "approximately" or "about," as applied to one or more values of interest, refers to a value that is similar to a stated reference value. In certain embodiments, "about" refers to a range of values that fall within 25%, 20%, 19%, 18%, 17%, 16%, 15%, 14%, 13%, 12%, 11%, 10%, 9%, 8%, 7%, 6%, 5%, 4%, 3%, 2%, 1%, or less in either direction (greater than or less than) of the stated reference value unless otherwise stated or otherwise evident from the context (except where such number would exceed 100% of a possible value).

As used herein, "administer," "administering," "administration" and the like refers to providing a substance (e.g., an oligonucleotide) to a subject in a manner that is pharmacologically useful (e.g., to treat a disease, disorder, or condition in the subject).

As used herein, "attenuate," "attenuating," "attenuation" and the like refers to reducing or effectively halting. As a non-limiting example, one or more of the treatments herein may reduce or effectively halt the onset or progression of non-alcoholic fatty liver disease (NAFLD), non-alcoholic steatohepatitis (NASH), or systemic lupus erythematosus in a subject. This attenuation may be exemplified by, for example, a decrease in one or more aspects (e.g., symptoms, tissue characteristics, and cellular, inflammatory, or immunological activity, etc.) of non-alcoholic fatty liver disease (NAFLD), non-alcoholic steatohepatitis (NASH), or systemic lupus erythematosus, no detectable progression (worsening) of one or more aspects fatty liver disease, or systemic lupus erythematosus, or no detectable aspects of non-alcoholic fatty liver disease (NAFLD), non-alcoholic steatohepatitis (NASH), or systemic lupus erythematosus in a subject when they might otherwise be expected.

As used herein, "complementary" refers to a structural relationship between two nucleotides (e.g., on two opposing nucleic acids or on opposing regions of a single nucleic acid strand) that permits the two nucleotides to form base pairs with one another. For example, a purine nucleotide of one nucleic acid that is complementary to a pyrimidine nucleotide of an opposing nucleic acid may base pair together by forming hydrogen bonds with one another. In some embodiments, complementary nucleotides can base pair in the Watson-Crick manner or in any other manner that allows for the formation of stable duplexes. In some embodiments, two nucleic acids may have regions of multiple nucleotides that are complementary with each other to form regions of complementarity, as described herein.

As used herein, "deoxyribonucleotide" refers to a nucleotide having a hydrogen in place of a hydroxyl at the 2' position of its pentose sugar when compared with a ribonucleotide. A modified deoxyribonucleotide is a deoxyribonucleotide having one or more modifications or substitutions of atoms other than at the 2' position, including modifications or substitutions in or of the sugar, phosphate group or base.

As used herein, "double-stranded oligonucleotide" or "ds oligonucleotide" refers to an oligonucleotide that is substantially in a duplex form. In some embodiments, the complementary base-pairing of duplex region(s) of a double-stranded oligonucleotide is formed between antiparallel sequences of nucleotides of covalently separate nucleic acid strands. In some embodiments, complementary base-pairing of duplex region(s) of a double-stranded oligonucleotide is formed between antiparallel sequences of nucleotides of nucleic acid strands that are covalently linked. In some embodiments, complementary base-pairing of duplex region(s) of a double-stranded oligonucleotide is formed from single nucleic acid strand that is folded (e.g., via a hairpin) to provide complementary antiparallel sequences of nucleotides that base pair together. In some embodiments, a double-stranded oligonucleotide comprises two covalently separate nucleic acid strands that are fully duplexed with one another. However, in some embodiments, a double-stranded oligonucleotide comprises two covalently separate nucleic acid strands that are partially duplexed (e.g., having overhangs at one or both ends). In some embodiments, a double-stranded oligonucleotide comprises antiparallel sequence of nucleotides that are partially complementary, and thus, may have one or more mismatches, which may include internal mismatches or end mismatches.

As used herein, "duplex," in reference to nucleic acids (e.g., oligonucleotides), refers to a structure formed through complementary base pairing of two antiparallel sequences of nucleotides.

As used herein, "excipient" refers to a non-therapeutic agent that may be included in a composition, for example, to provide or contribute to a desired consistency or stabilizing effect.

As used herein, "hepatocyte" or "hepatocytes" refers to cells of the parenchymal tissues of the liver. These cells make up about 70-85% of the liver's mass and manufacture serum albumin, FBN and the prothrombin group of clotting factors (except for Factors 3 and 4). Markers for hepatocyte lineage cells include, but are not limited to, transthyretin (Ttr), glutamine synthetase (Glul), hepatocyte nuclear factor 1a (Hnf1a) and hepatocyte nuclear factor 4a (Hnf4a). Markers for mature hepatocytes may include, but are not limited to, cytochrome P450 (Cyp3a11), fumarylacetoacetate hydrolase (Fah), glucose 6-phosphate (G6p), albumin (Alb) and OC2-2F8. See, e.g., Huch et al. NATURE (2013); 494: 247-50.

As used herein, a "hepatotoxic agent" refers to a chemical compound, virus or other substance that is itself toxic to the liver or can be processed to form a metabolite that is toxic to the liver. Hepatotoxic agents may include, but are not limited to, carbon tetrachloride ($CCl_4$), acetaminophen (paracetamol), vinyl chloride, arsenic, chloroform, nonsteroidal anti-inflammatory drugs (such as aspirin and phenylbutazone).

As used herein, the term "NR1H3" refers to the gene which encodes to the protein Liver X receptor alpha, or LXR-alpha. LXR-alpha is a nuclear receptor protein that is encoded by NR1H3 (nuclear receptor subfamily 1, group H, member 3). The term "NR1H3" is intended to refer to all isoforms unless stated otherwise.

As used herein, "labile linker" refers to a linker that can be cleaved (e.g., by acidic pH). A "fairly stable linker" refers to a linker that cannot be readily cleaved.

As used herein, "liver inflammation" or "hepatitis" refers to a physical condition in which the liver becomes swollen, dysfunctional and/or painful, especially as a result of injury or infection, as may be caused by exposure to a hepatotoxic agent. Symptoms may include jaundice (yellowing of the skin or eyes), fatigue, weakness, nausea, vomiting, appetite reduction and weight loss. Liver inflammation, if left untreated, may progress to fibrosis, cirrhosis, liver failure or liver cancer.

As used herein, "liver fibrosis" "Liver Fibrosis" or "fibrosis of the liver" refers to an excessive accumulation in the liver of extracellular matrix proteins, which could include collagens (I, III, and IV), FBN, undulin, elastin, laminin, hyaluronan and proteoglycans resulting from inflammation and liver cell death. Liver fibrosis, if left untreated, may progress to cirrhosis, liver failure or liver cancer.

As used herein, "loop" refers to an unpaired region of a nucleic acid (e.g., oligonucleotide) that is flanked by two antiparallel regions of the nucleic acid that are sufficiently complementary to one another, such that under appropriate hybridization conditions (e.g., in a phosphate buffer, in a cell), the two antiparallel regions, which flank the unpaired region, hybridize to form a duplex (referred to as a "stem").

As used herein, "Metabolic syndrome' or "metabolic liver disease" refers to a disorder characterized by a cluster of associated medical conditions and associated pathologies including, but not limited to the following medical conditions: abdominal obesity, elevated blood pressure, elevated fasting plasma glucose, high serum triglycerides, liver fibrosis, and low levels of high-density lipoprotein (HDL) levels. As used herein, the term metabolic syndrome or metabolic liver disease may encompass a wide array of direct and indirect manifestations, diseases and pathologies associated with metabolic syndrome and metabolic liver disease, with an expanded list of conditions used throughout the document.

As used herein, "modified internucleotide linkage" refers to an internucleotide linkage having one or more chemical modifications when compared with a reference internucleotide linkage comprising a phosphodiester bond. In some embodiments, a modified nucleotide is a non-naturally occurring linkage. Typically, a modified internucleotide linkage confers one or more desirable properties to a nucleic acid in which the modified internucleotide linkage is present. For example, a modified internucleotide linkage may improve thermal stability, resistance to degradation, nuclease resistance, solubility, bioavailability, bioactivity, reduced immunogenicity, etc.

As used herein, "modified nucleotide" refers to a nucleotide having one or more chemical modifications when compared with a corresponding reference nucleotide selected from: adenine ribonucleotide, guanine ribonucleotide, cytosine ribonucleotide, uracil ribonucleotide, adenine deoxyribonucleotide, guanine deoxyribonucleotide, cytosine deoxyribonucleotide and thymidine deoxyribonucleotide. In some embodiments, a modified nucleotide is a non-naturally occurring nucleotide. In some embodiments, a modified nucleotide has one or more chemical modification in its sugar, nucleobase and/or phosphate group. In some embodiments, a modified nucleotide has one or more chemical moieties conjugated to a corresponding reference nucleotide. Typically, a modified nucleotide confers one or more desirable properties to a nucleic acid in which the modified nucleotide is present. For example, a modified nucleotide may improve thermal stability, resistance to degradation, nuclease resistance, solubility, bioavailability, bioactivity, reduced immunogenicity, etc.

As used herein, "nicked tetraloop structure" refers to a structure of a RNAi oligonucleotide that is characterized by separate sense (passenger) and antisense (guide) strands, in which the sense strand has a region of complementarity with the antisense strand, and in which at least one of the strands, generally the sense strand, has a tetraloop configured to stabilize an adjacent stem region formed within the at least one strand.

As used herein, "oligonucleotide" refers to a short nucleic acid (e.g., less than about 100 nucleotides in length). An oligonucleotide may be single-stranded (ss) or double-stranded (ds). An oligonucleotide may or may not have duplex regions. As a set of non-limiting examples, an oligonucleotide may be, but is not limited to, a small interfering RNA (siRNA), microRNA (miRNA), short hairpin RNA (shRNA), dicer substrate interfering RNA (DsiRNA), antisense oligonucleotide, short siRNA or ss siRNA. In some embodiments, a double-stranded (dsRNA) is an RNAi oligonucleotide.

As used herein, "overhang" refers to terminal non-base pairing nucleotide(s) resulting from one strand or region extending beyond the terminus of a complementary strand with which the one strand or region forms a duplex. In some embodiments, an overhang comprises one or more unpaired nucleotides extending from a duplex region at the 5' terminus or 3' terminus of an oligonucleotide. In certain embodiments, the overhang is a 3'- or 5'-overhang on the antisense strand or sense strand of an oligonucleotide.

As used herein, "phosphate analog" refers to a chemical moiety that mimics the electrostatic and/or steric properties of a phosphate group. In some embodiments, a phosphate analog is positioned at the 5' terminal nucleotide of an oligonucleotide in place of a 5'-phosphate, which is often susceptible to enzymatic removal. In some embodiments, a 5' phosphate analog contains a phosphatase-resistant linkage. Examples of phosphate analogs include, but are not limited to, 5' phosphonates, such as 5' methylene phosphonate (5'-MP) and 5'-(E)-vinylphosphonate (5'-VP). In some embodiments, an oligonucleotide has a phosphate analog at a 4'-carbon position of the sugar (referred to as a "4'-phosphate analog") at a 5'-terminal nucleotide. An example of a 4'-phosphate analog is oxymethylphosphonate, in which the oxygen atom of the oxymethyl group is bound to the sugar moiety (e.g., at its 4'-carbon) or analog thereof. See, e.g., US Provisional Patent Application Nos. 62/383,207 (filed on 2 Sep. 2016) and 62/393,401 (filed on 12 Sep. 2016). Other modifications have been developed for the 5' end of oligonucleotides (see, e.g., Intl. Patent Application No. WO 2011/133871; U.S. Pat. No. 8,927,513; and Prakash et al. NUCLEIC ACIDS RES. (2015); 43: 2993-3011).

As used herein, "reduced expression" of a gene (e.g., NR1H3) refers to a decrease in the amount or level of RNA transcript (e.g., NR1H3 mRNA) or protein encoded by the gene and/or a decrease in the amount or level of activity of the gene in a cell, a population of cells, a sample, or a subject, when compared to an appropriate reference (e.g., a reference cell, population of cells, sample or subject). For example, the act of contacting a cell with an oligonucleotide herein (e.g., an oligonucleotide comprising an antisense strand having a nucleotide sequence that is complementary to a nucleotide sequence comprising NR1H3 mRNA) may result in a decrease in the amount or level of NR1H3 mRNA, protein and/or activity (e.g., via degradation of NR1H3 mRNA by the RNAi pathway) when compared to a cell that is not treated with the oligonucleotide. Similarly, and as used herein, "reducing expression" refers to an act that results in reduced expression of a gene (e.g., NR1H3).

As used herein, "reduction of NR1H3 expression" refers to a decrease in the amount or level of NR1H3 mRNA, NR1H3 protein and/or NR1H3 activity in a cell, a population of cells, a sample or a subject when compared to an appropriate reference (e.g., a reference cell, population of cells, sample, or subject).

As used herein, "region of complementarity" refers to a sequence of nucleotides of a nucleic acid (e.g., an oligonucleotide) that is sufficiently complementary to an antiparallel sequence of nucleotides to permit hybridization between the two sequences of nucleotides under appropriate hybridization conditions (e.g., in a phosphate buffer, in a cell, etc.). In some embodiments, an oligonucleotide herein comprises a targeting sequence having a region of complementary to a mRNA target sequence.

As used herein, "ribonucleotide" refers to a nucleotide having a ribose as its pentose sugar, which contains a hydroxyl group at its 2' position. A modified ribonucleotide is a ribonucleotide having one or more modifications or substitutions of atoms other than at the 2' position, including modifications or substitutions in or of the ribose, phosphate group or base.

As used herein, "RNAi oligonucleotide" refers to either (a) a double-stranded oligonucleotide having a sense strand (passenger) and antisense strand (guide), in which the antisense strand or part of the antisense strand is used by the Argonaute 2 (Ago2) endonuclease in the cleavage of a target mRNA (e.g., NR1H3 mRNA) or (b) a single-stranded oligonucleotide having a single antisense strand, where that antisense strand (or part of that antisense strand) is used by the Ago2 endonuclease in the cleavage of a target mRNA (e.g., NR1H3 mRNA).

As used herein, "strand" refers to a single, contiguous sequence of nucleotides linked together through internucleotide linkages (e.g., phosphodiester linkages or phosphorothioate linkages). In some embodiments, a strand has two free ends (e.g., a 5' end and a 3' end).

As used herein, "subject" means any mammal, including mice, rabbits, and humans. In one embodiment, the subject is a human or NHP. Moreover, "individual" or "patient" may be used interchangeably with "subject."

As used herein, "synthetic" refers to a nucleic acid or other molecule that is artificially synthesized (e.g., using a machine (e.g., a solid-state nucleic acid synthesizer)) or that is otherwise not derived from a natural source (e.g., a cell or organism) that normally produces the molecule.

As used herein, "targeting ligand" refers to a molecule (e.g., a carbohydrate, amino sugar, cholesterol, polypeptide, or lipid) that selectively binds to a cognate molecule (e.g., a receptor) of a tissue or cell of interest and that is conjugatable to another substance for purposes of targeting the other substance to the tissue or cell of interest. For example, in some embodiments, a targeting ligand may be conjugated to an oligonucleotide for purposes of targeting the oligonucleotide to a specific tissue or cell of interest. In some embodiments, a targeting ligand selectively binds to a cell surface receptor. Accordingly, in some embodiments, a targeting ligand when conjugated to an oligonucleotide facilitates delivery of the oligonucleotide into a particular cell through selective binding to a receptor expressed on the surface of the cell and endosomal internalization by the cell of the complex comprising the oligonucleotide, targeting ligand and receptor. In some embodiments, a targeting ligand is conjugated to an oligonucleotide via a linker that is cleaved following or during cellular internalization such that the oligonucleotide is released from the targeting ligand in the cell. In some embodiments, the targeting ligand comprises at least one GalNAc moiety and targets the liver and human liver cells (e.g., human hepatocytes).

As used herein, "tetraloop" refers to a loop that increases stability of an adjacent duplex formed by hybridization of flanking sequences of nucleotides. The increase in stability is detectable as an increase in melting temperature ($T_m$) of an adjacent stem duplex that is higher than the $T_m$ of the adjacent stem duplex expected, on average, from a set of loops of comparable length consisting of randomly selected sequences of nucleotides. For example, a tetraloop can confer a $T_m$ of at least about 50° C., at least about 55° C., at least about 56° C., at least about 58° C., at least about 60° C., at least about 65° C., or at least about 75° C. in 10 mM $Na_2HPO_4$ to a hairpin comprising a duplex of at least 2 base pairs (bp) in length. In some embodiments, a tetraloop can confer a $T_m$ of at least about 50° C., at least about 55° C., at least about 56° C., at least about 58° C., at least about 60° C., at least about 65° C., or at least about 75° C. in 10 mM $NaH_2PO_4$ to a hairpin comprising a duplex of at least 2 base pairs (bp) in length. In some embodiments, a tetraloop may stabilize a bp in an adjacent stem duplex by stacking interactions. In addition, interactions among the nucleotides in a tetraloop include, but are not limited to, non-Watson-Crick base pairing, stacking interactions, hydrogen bonding and contact interactions (Cheong et al. NATURE (1990); 346: 680-82; and Heus & Pardi SCIENCE (1991); 253: 191-94). In some embodiments, a tetraloop comprises or consists of 3 to 6 nucleotides and is typically 4 to 5 nucleotides. In certain embodiments, a tetraloop comprises or consists of 3, 4, 5, or 6 nucleotides, which may or may not be modified (e.g., which may or may not be conjugated to a targeting moiety). In one embodiment, a tetraloop consists of 4 nucleotides. Any nucleotide may be used in the tetraloop and standard IUPAC-IUB symbols for such nucleotides may be used as described in Cornish-Bowden NUCLEIC ACIDS RES. (1985); 13: 3021-30. For example, the letter "N" may be used to mean that any base may be in that position, the letter "R" may be used to show that A (adenine) or G (guanine) may be in that position, and "B" may be used to show that C (cytosine), G (guanine), or T (thymine) may be in that position. Examples of tetraloops include the UNCG family of tetraloops (e.g., UUCG), the GNRA family of tetraloops (e.g., GAAA), and the CUUG tetraloop (Woese et al. PROC. NATL. ACAD. SCI. USA (1990); 87: 8467-71; Antao et al. NUCLEIC ACIDS RES. (1991); 19: 5901-05). Examples of DNA tetraloops include the d(GNNA) family of tetraloops (e.g., d(GTTA), the d(GNRA)) family of tetraloops, the d(GNAB) family of tetraloops, the d(CNNG) family of tetraloops, and the d(TNCG) family of tetraloops (e.g., d(TTCG)). See, e.g., Nakano et al. BIOCHEM. (2002); 41: 14281-92; Shinji et al. NIPPON KAGAKKAI KOEN YOKOSHU (2000); 78: 731. In some embodiments, the tetraloop is contained within a nicked tetraloop structure.

As used herein, "treat" or "treating" refers to the act of providing care to a subject in need thereof, for example, by administering a therapeutic agent (e.g., an oligonucleotide herein) to the subject, for purposes of improving the health and/or well-being of the subject with respect to an existing condition (e.g., a disease, disorder) or to prevent or decrease the likelihood of the occurrence of a condition. In some embodiments, treatment involves reducing the frequency or severity of at least one sign, symptom or contributing factor of a condition (e.g., disease, disorder) experienced by a subject.

EXAMPLES

While the disclosure has been described with reference to the specific embodiments set forth in the following Examples, it should be understood by those skilled in the art that various changes may be made, and equivalents may be substituted without departing from the true spirit and scope of the disclosure. Further, the following Examples are offered by way of illustration and are not intended to limit the scope of the disclosure in any manner. In addition, modifications may be made to adapt to a situation, material, composition of matter, process, process step or steps, to the objective, spirit, and scope of the disclosure. All such modifications are intended to be within the scope of the disclosure. Standard techniques well known in the art or the techniques specifically described below were utilized.

Example 1: Preparation of RNAi Oligonucleotides

Oligonucleotide Synthesis and Purification

The oligonucleotides (RNAi oligonucleotides) described in the foregoing Examples are chemically synthesized using methods described herein. Generally, RNAi oligonucleotides are synthesized using solid phase oligonucleotide synthesis methods as described for 19-23mer siRNAs (see, e.g., Scaringe et al. NUCLEIC ACIDS RES. (1990); 18: 5433-41 and Usman et al. J. AM. CHEM. SOC. (1987); 109: 7845-45; see also, U.S. Pat. Nos. 5,804,683; 5,831,071; 5,998,203; 6,008,400; 6,111,086; 6,117,657; 6,353,098; 6,362,323; 6,437,117 and 6,469,158) in addition to using known phosphoramidite synthesis (see, e.g. Hughes and Ellington, COLD SPRING HARB. PERSPECT. BIOL. (2017); 9(1): a023812; Beaucage S. L., Caruthers M. H. *Studies on Nucleotide Chemistry V.: Deoxynucleoside Phosphoramidites A New Class of Key Intermediates for Deoxypolynucleotide Synthesis*, TETRAHEDRON LETT. (1981); 22: 1859-62. doi:10.1016/S0040-4039(01)90461-7). dsRNAi oligonucleotides having a 19mer core sequence were formatted into constructs having a 25mer sense strand and a 27mer antisense strand to allow for processing by the RNAi machinery. The 19mer core sequence is complementary to a region in the NR1H3 mRNA.

Individual RNA strands were synthesized and HPLC purified according to standard methods (Integrated DNA Technologies; Coralville, Iowa). For example, RNA oligonucleotides were synthesized using solid phase phosphoramidite chemistry, deprotected and desalted on NAP-5 columns (Amersham Pharmacia Biotech; Piscataway, N.J.) using standard techniques (Damha & Olgivie, METHODS MOL. BIOL. (1993); 20: 81-114; Wincott et al. NUCLEIC ACIDS RES. (1995); 23: 2677-84). The oligomers were purified using ion-exchange high performance liquid chromatography (IE-HPLC) on an Amersham Source 15Q column (1.0 cm×25 cm; Amersham Pharmacia Biotech) using a 15 min step-linear gradient. The gradient varied from 90:10 Buffers A:B to 52:48 Buffers A:B, where Buffer A is 100 mM Tris pH 8.5 and Buffer B is 100 mM Tris pH 8.5, 1 M NaCl. Samples were monitored at 260 nm and peaks corresponding to the full-length oligonucleotide species were collected, pooled, desalted on NAP-5 columns, and lyophilized.

The purity of each oligomer was determined by capillary electrophoresis (CE) on a Beckman PACE 5000 (Beckman Coulter, Inc.; Fullerton, Calif.). The CE capillaries have a 100 m inner diameter and contain ssDNA 100R Gel (Beckman-Coulter). Typically, about 0.6 nmole of oligonucleotide was injected into a capillary, run in an electric field of 444 V/cm, and was detected by UV absorbance at 260 nm. Denaturing Tris-Borate-7 M-urea running buffer was purchased from Beckman-Coulter. Oligoribonucleotides were obtained that were at least 90% pure as assessed by CE for use in experiments described below. Compound identity was verified by matrix-assisted laser desorption ionization time-of-flight (MALDI-TOF) mass spectroscopy on a Voyager DE™ Biospectometry Work Station (Applied Biosystems; Foster City, Calif.) following the manufacturer's recommended protocol. Relative molecular masses of all oligomers were obtained, often within 0.2% of expected molecular mass.

Preparation of Duplexes

Single strand RNA oligomers were resuspended (e.g., at 100 μM concentration) in duplex buffer consisting of 100 mM potassium acetate, 30 mM HEPES, pH 7.5. Complementary sense and antisense strands were mixed in equal molar amounts to yield a final solution of, for example, 50 μM duplex. Samples were heated to 100° C. for 5' in RNA buffer (IDT) and were allowed to cool to room temperature before use. The RNAi oligonucleotides were stored at −20° C. Single strand RNA oligomers were stored lyophilized or in nuclease-free water at −80° C.

Example 2: Generation of NR1H3-Targeting Double Stranded RNAi Oligonucleotides Identification of NR1H3 mRNA Target Sequences Nuclear Receptor Subfamily 1 Group H Member 3 (NR1H3) is a protein that regulates macrophage function, lipid homeostasis, and inflammation. To generate RNAi oligonucleotide inhibitors of NR1H3 expression, a computer-based algorithm was used to computationally identify NR1H3 mRNA target sequences suitable for assaying inhibition of NR1H3 expression by the RNAi pathway. The algorithm provided RNAi oligonucleotide guide (antisense) strand sequences each having a region of complementarity to a suitable NR1H3 target sequence of human NR1H3 mRNA. Some of the guide strand sequences identified by the algorithm were also complementary to the corresponding NR1H3 target sequence of monkey and/or mouse NR1H3 mRNA. NR1H3 RNAi oligonucleotides comprising a region of complementarity to homologous NR1H3 mRNA target sequences with nucleotide sequence similarity are predicted to have the ability to target homologous NR1H3 mRNAs.

RNAi oligonucleotides (formatted as DsiRNA oligonucleotides) were generated as described in Example 1 for evaluation in vitro. Each DsiRNA was generated with the same modification pattern, and each with a unique guide strand having a region of complementarity to a NR1H3 target sequence identified by the algorithm. Modifications for the sense and anti-sense DsiRNA included the following (X— any nucleotide; m—2'-O-methyl modified nucleotide; r-ribosyl modified nucleotide):

Sense Strand:
rXmXrXmXrXrXrXrXrXrXrXrXrXmXrXmXrXrXrXrXrXrXrXXX

Anti-sense Strand:
mXmXmXmXrXrXrXrXrXmXrXmXrXrXrXrXrXrXrXrXmXrXmXmXmX

In Vitro Cell-Based Assays

The ability of each of the modified DsiRNA in Table 1 to reduce NR1H3 mRNA was measured using in vitro cell-based assays. Briefly, human Huh-7 cells expressing endogenous human NR1H3 gene were transfected with each of the DsiRNAs listed in Table 1 at 1 nM in separate wells of a multi-well cell-culture plate. Cells were maintained for 24 hours following transfection with the modified DsiRNA, and then the amount of remaining NR1H3 mRNA from the transfected cells was determined using and RT-qPCR assay. The assay used the following primers and probe normalized to the geometric mean of two reference genes HPRT1 and SFRS9: Forward-1198 GTTATAACCGGGAAGACTTTGC (SEQ ID NO:1122); Reverse-1326: TGATAGCAATGAGCAAGGCA (SEQ ID NO: 1123); Probe-1253: ATGGCCCTGGAGAACTCGAAGATG (SEQ ID NO:1124). The primer pair was assayed for % remaining RNA as shown in Table 1. DsiRNAs resulting in less than or equal to 10% NR1H3 mRNA remaining in DsiRNA-transfected cells when compared to mock-transfected cells were considered DsiRNA "hits". The HuH-7 cell-based assay evaluating the ability of the DsiRNAs listed in Table 1 to inhibit NR1H3 expression identified several candidate DsiRNAs.

Taken together, these results show that DsiRNAs designed to target human NR1H3 mRNA inhibit NR1H3 expression in cells, as determined by a reduced amount of NR1H3 mRNA in DsiRNA-transfected cells relative to control cells. These results demonstrate that the nucleotide sequences comprising the DsiRNA are useful for generating RNAi oligonucleotides to inhibit NR1H3 expression. Further, these results demonstrate that multiple NR1H3 mRNA target sequences are suitable for the RNAi-mediated inhibition of NR1H3 expression.

TABLE 1

In Vitro Screening Results

| SED ID NO (Sense Strand) | SED ID NO (Anti-sense Strand) | DsiRNA name | NR1H3-V1198 % remaining | SEM |
|---|---|---|---|---|
| 1 | 385 | NR1H3-764-784-861 | 8.9 | 4.43 |
| 2 | 386 | NR1H3-766-786-863 | 16.25 | 3.11 |
| 3 | 387 | NR1H3-789-809-886 | 15.08 | 1.03 |
| 4 | 388 | NR1H3-790-810-887 | 18.74 | 3.03 |
| 5 | 389 | NR1H3-791-811-888 | 40.34 | 2.62 |
| 6 | 390 | NR1H3-792-812-889 | 32.44 | 4.47 |
| 7 | 391 | NR1H3-793-813-890 | 33.77 | 2.89 |
| 8 | 392 | NR1H3-795-815-892 | 10.87 | 4.86 |
| 9 | 393 | NR1H3-796-816-893 | 14.94 | 1.85 |
| 10 | 394 | NR1H3-797-817-894 | 45.07 | 9.79 |
| 11 | 395 | NR1H3-798-818-895 | 17.91 | 4.71 |
| 12 | 396 | NR1H3-799-819-896 | 17.87 | 2.13 |
| 13 | 397 | NR1H3-802-822-899 | 8.47 | 3.71 |
| 14 | 398 | NR1H3-803-823-900 | 26.43 | 3.01 |
| 15 | 399 | NR1H3-804-824-901 | 13.60 | 2.34 |
| 16 | 400 | NR1H3-806-826-903 | 47.05 | 7.86 |
| 17 | 401 | NR1H3-808-828-905 | 14.07 | 1.86 |
| 18 | 402 | NR1H3-809-829-906 | 37.06 | 10.23 |
| 19 | 403 | NR1H3-810-830-907 | 27.90 | 12.22 |
| 20 | 404 | NR1H3-811-831-908 | 41.69 | 8.58 |
| 21 | 405 | NR1H3-813-833-910 | 29.81 | 2.83 |
| 22 | 406 | NR1H3-844 | 22.31 | 3.43 |
| 23 | 407 | NR1H3-895-915-992 | 13.4 | 2.84 |
| 24 | 408 | NR1H3-898-918-995 | 21.63 | 3.63 |
| 25 | 409 | NR1H3-915-935 | 23.64 | 3.59 |
| 26 | 410 | NR1H3-917-937 | 13.58 | 3.29 |
| 27 | 411 | NR1H3-922-942 | 21.35 | 3.75 |
| 28 | 412 | NR1H3-924-944 | 32.89 | 16.44 |
| 29 | 413 | NR1H3-925-945 | 15.74 | 4.69 |
| 30 | 414 | NR1H3-927-947 | 26.60 | 5.18 |
| 31 | 415 | NR1H3-928-948 | 14.55 | 3.21 |
| 32 | 416 | NR1H3-929-949 | 9.89 | 1.40 |
| 33 | 417 | NR1H3-930-950 | 26.20 | 3.86 |
| 34 | 418 | NR1H3-931-951 | 27.44 | 1.62 |
| 35 | 419 | NR1H3-932-952 | 12.31 | 6.33 |
| 36 | 420 | NR1H3-933-953 | 13.29 | 1.84 |
| 37 | 421 | NR1H3-941-961 | 10.08 | 2.10 |
| 38 | 422 | NR1H3-944-964 | 13.78 | 1.05 |
| 39 | 423 | NR1H3-945-965 | 27.16 | 2.75 |
| 40 | 424 | NR1H3-946-966 | 15.99 | 1.88 |
| 41 | 425 | NR1H3-947-967 | 8.63 | 3.01 |
| 42 | 426 | NR1H3-949-969 | 17.43 | 1.64 |
| 43 | 427 | NR1H3-951-971 | 9.66 | 1.70 |
| 44 | 428 | NR1H3-952-972 | 9.92 | 1.39 |
| 45 | 429 | NR1H3-953-973 | 21.75 | 4.12 |
| 46 | 430 | NR1H3-1151-1171 | 18.83 | 2.78 |
| 47 | 431 | NR1H3-1153-1173 | 78.76 | 9.71 |
| 48 | 432 | NR1H3-1154-1174 | 45.38 | 5.78 |
| 49 | 433 | NR1H3-1155-1175 | 23.72 | 2.37 |
| 50 | 434 | NR1H3-1156-1176 | 23.75 | 2.37 |
| 51 | 435 | NR1H3-1157-1177 | 67.42 | 6.83 |
| 52 | 436 | NR1H3-1158-1178 | 17.98 | 2.57 |
| 53 | 437 | NR1H3-1159-1179 | 17.47 | 2.49 |
| 54 | 438 | NR1H3-1159-1180 | 9.14 | 1.61 |
| 55 | 439 | NR1H3-1161-1181 | 22.52 | 2.41 |
| 56 | 440 | NR1H3-1162-1182 | 10.89 | 1.66 |
| 57 | 441 | NR1H3-1163-1183 | 38.50 | 7.62 |
| 58 | 442 | NR1H3-1164-1184 | 23.52 | 9.14 |
| 59 | 443 | NR1H3-1165-1185 | 22.81 | 3.68 |
| 60 | 444 | NR1H3-1166-1186 | 23.01 | 4.64 |
| 61 | 445 | NR1H3-1167-1187 | 50.54 | 10.76 |
| 62 | 446 | NR1H3-1169-1189 | 15.60 | 2.02 |
| 63 | 447 | NR1H3-1170-1190 | 22.78 | 5.79 |
| 64 | 448 | NR1H3-1171-1191 | 80.98 | 9.76 |
| 65 | 449 | NR1H3-1173-1193 | 16.14 | 4.16 |
| 66 | 450 | NR1H3-1175-1195 | 45.81 | 7.47 |
| 67 | 451 | NR1H3-1176-1196 | 18.32 | 4.59 |
| 68 | 452 | NR1H3-1177-1197 | 26.85 | 5.22 |
| 69 | 453 | NR1H3-1178-1198 | 63.10 | 17.52 |
| 70 | 454 | NR1H3-1179-1199 | 12.86 | 1.65 |
| 71 | 455 | NR1H3-1180-1200 | 20.97 | 4.62 |
| 72 | 456 | NR1H3-1181-1201 | 16.21 | 4.23 |
| 73 | 457 | NR1H3-1182-1202 | 30.61 | 5.64 |
| 74 | 458 | NR1H3-1183-1203 | 30.96 | 6.72 |
| 75 | 459 | NR1H3-1184-1204 | 23.71 | 6.05 |
| 76 | 460 | NR1H3-1185-1205 | 14.77 | 1.30 |
| 77 | 461 | NR1H3-1186-1206 | 19.94 | 6.28 |
| 78 | 462 | NR1H3-1187-1207 | 14.48 | 1.77 |
| 79 | 463 | NR1H3-1188-1208 | 37.28 | 3.76 |
| 80 | 464 | NR1H3-1190-1210 | 38.58 | 4.63 |
| 81 | 465 | NR1H3-1191-1211 | 15.02 | 2.19 |
| 82 | 466 | NR1H3-1192-1212 | 51.23 | 7.43 |
| 83 | 467 | NR1H3-1193-1213 | 17.05 | 3.23 |
| 84 | 468 | NR1H3-1194-1214 | 31.91 | 6.24 |
| 85 | 469 | NR1H3-1196-1216 | 32.00 | 9.03 |
| 86 | 470 | NR1H3-1197-1217 | 8.36 | 2.55 |
| 87 | 471 | NR1H3-1198-1218 | 29.10 | 4.48 |
| 88 | 472 | NR1H3-1199-1219 | 13.22 | 2.89 |
| 89 | 473 | NR1H3-1200-1220 | 8.59 | 2.38 |
| 90 | 474 | NR1H3-1203-1223 | 15.92 | 3.29 |
| 91 | 475 | NR1H3-1204-1224 | 5.07 | 0.83 |
| 92 | 476 | NR1H3-1207-1227 | 3.54 | 2.18 |
| 93 | 477 | NR1H3-1211-1231 | 1.88 | 1.19 |
| 94 | 478 | NR1H3-1212-1232 | 17.48 | 7.55 |
| 95 | 479 | NR1H3-1213-1233 | 8.32 | 4.17 |
| 96 | 480 | NR1H3-1214-1234 | 16.53 | 1.70 |
| 97 | 481 | NR1H3-1215-1235 | 11.84 | 1.93 |
| 98 | 482 | NR1H3-1216-1236 | 9.48 | 1.67 |
| 99 | 483 | NR1H3-1217-1237 | 11.9 | 2.34 |
| 100 | 484 | NR1H3-1218-1238 | 8.45 | 1.98 |
| 101 | 485 | NR1H3-1219-1239 | 6.80 | 1.35 |
| 102 | 486 | NR1H3-1220-1240 | 3.60 | 1.88 |
| 103 | 487 | NR1H3-1222-1242 | 8.53 | 1.67 |
| 104 | 488 | NR1H3-1223-1243 | 12.69 | 1.63 |
| 105 | 489 | NR1H3-1224-1244 | 6.15 | 2.42 |
| 106 | 490 | NR1H3-1225-1245 | 9.72 | 3.87 |
| 107 | 491 | NR1H3-1226-1246 | 47.24 | 5.54 |
| 108 | 492 | NR1H3-1227-1247 | 13.80 | 2.63 |
| 109 | 493 | NR1H3-1228-1248 | 6.76 | 1.78 |
| 110 | 494 | NR1H3-1229-1249 | 8.75 | 2.71 |
| 111 | 495 | NR1H3-1232-1252 | 36.21 | 3.20 |
| 112 | 496 | NR1H3-1233-1253 | 20.37 | 2.75 |
| 113 | 497 | NR1H3-1234-1254 | 18.42 | 1.50 |
| 114 | 498 | NR1H3-1235-1255 | 16.37 | 1.48 |
| 115 | 499 | NR1H3-1236-1256 | 58.83 | 6.78 |
| 116 | 500 | NR1H3-1237-1257 | 16.03 | 2.29 |
| 117 | 501 | NR1H3-1238-1258 | 19.29 | 5.59 |
| 118 | 502 | NR1H3-1241-1261 | 12.44 | 2.25 |
| 119 | 503 | NR1H3-1242-1262 | 29.53 | 10.05 |
| 120 | 504 | NR1H3-1243-1263 | 6.22 | 5.33 |
| 121 | 505 | NR1H3-1244-1264 | 5.51 | 0.94 |
| 122 | 506 | NR1H3-1245-1265 | 15.00 | 2.82 |
| 123 | 507 | NR1H3-1246-1266 | 10.14 | 2.84 |
| 124 | 508 | NR1H3-1247-1267 | 13.70 | 3.55 |
| 125 | 509 | NR1H3-1248-1268 | 37.81 | 4.12 |
| 126 | 510 | NR1H3-1250-1270 | 10.08 | 2.10 |
| 127 | 511 | NR1H3-1251-1271 | 6.50 | 0.47 |
| 128 | 512 | NR1H3-1252-1272 | 3.35 | 0.65 |
| 129 | 513 | NR1H3-1253-1273 | 14.22 | 1.35 |
| 130 | 514 | NR1H3-1256-1276 | 8.26 | 1.63 |
| 131 | 515 | NR1H3-1258-1278 | 7.38 | 1.26 |
| 132 | 516 | NR1H3-1259-1279 | 4.72 | 1.13 |
| 133 | 517 | NR1H3-1261-1281 | 4.39 | 1.31 |
| 134 | 518 | NR1H3-1262-1282 | 27.66 | 5.46 |
| 135 | 519 | NR1H3-1265-1285 | 3.35 | 1.10 |
| 136 | 520 | NR1H3-1266-1286 | 4.91 | 0.83 |

TABLE 1-continued

In Vitro Screening Results

| SED ID NO (Sense Strand) | SED ID NO (Anti-sense Strand) | DsiRNA name | NR1H3-V1198 % remaining | SEM |
|---|---|---|---|---|
| 137 | 521 | NR1H3-1267-1287 | 21.91 | 4.48 |
| 138 | 522 | NR1H3-1268-1288 | 21.59 | 3.96 |
| 139 | 523 | NR1H3-1269-1289 | 11.31 | 1.44 |
| 140 | 524 | NR1H3-1270-1290 | 9.87 | 5.24 |
| 141 | 525 | NR1H3-1271-1291 | 6.95 | 1.9 |
| 142 | 526 | NR1H3-1272-1292 | 7.07 | 0.99 |
| 143 | 527 | NR1H3-1273-1293 | 11.01 | 3.72 |
| 144 | 528 | NR1H3-1275-1295 | 18.49 | 2.31 |
| 145 | 529 | NR1H3-1276-1296 | 17.77 | 3.25 |
| 146 | 530 | NR1H3-1277-1297 | 18.20 | 1.62 |
| 147 | 531 | NR1H3-1278-1298 | 9.35 | 1.70 |
| 148 | 532 | NR1H3-1279-1299 | 8.96 | 1.60 |
| 149 | 533 | NR1H3-1280-1300 | 19.16 | 3.95 |
| 150 | 534 | NR1H3-1281-1301 | 12.33 | 1.94 |
| 151 | 535 | NR1H3-1282-1302 | 40.52 | 7.51 |
| 152 | 536 | NR1H3-1283-1303 | 15.26 | 7.23 |
| 153 | 537 | NR1H3-1284-1304 | 37.09 | 9.79 |
| 154 | 538 | NR1H3-1285-1305 | 29.28 | 4.88 |
| 155 | 539 | NR1H3-1286-1306 | 41.56 | 4.92 |
| 156 | 540 | NR1H3-1288-1308 | 68.84 | 4.13 |
| 157 | 541 | NR1H3-1289-1309 | 34.44 | 10.86 |
| 158 | 542 | NR1H3-1290-1310 | 17.67 | 3.83 |
| 159 | 543 | NR1H3-1291-1311 | 21.47 | 2.26 |
| 160 | 544 | NR1H3-1292-1312 | 41.99 | 7.72 |
| 161 | 545 | NR1H3-1293-1313 | 13.77 | 1.40 |
| 162 | 546 | NR1H3-1294-1314 | 20.97 | 3.76 |
| 163 | 547 | NR1H3-1295-1315 | 14.39 | 3.21 |
| 164 | 548 | NR1H3-1296-1316 | 28.04 | 10.25 |
| 165 | 549 | NR1H3-1297-1317 | 12.70 | 2.20 |
| 166 | 550 | NR1H3-1338-1358 | 22.20 | 4.81 |
| 167 | 551 | NR1H3-1339-1359 | 7.86 | 1.5 |
| 168 | 552 | NR1H3-1340-1360 | 4.72 | 1.10 |
| 169 | 553 | NR1H3-1341-1361 | 11.49 | 4.26 |
| 170 | 554 | NR1H3-1342-1362 | 4.84 | 1.18 |
| 171 | 555 | NR1H3-1343-1363 | 17.05 | 4.21 |
| 172 | 556 | NR1H3-1344-1364 | 13.83 | 6.27 |
| 173 | 557 | NR1H3-1345-1365 | 9.55 | 1.22 |
| 174 | 558 | NR1H3-1346-1366 | 4.54 | 1.14 |
| 175 | 559 | NR1H3-1347-1367 | 6.47 | 1.87 |
| 176 | 560 | NR1H3-1377-1443 | 46.13 | 5.08 |
| 177 | 561 | NR1H3-1379-1445 | 28.21 | 2.69 |
| 178 | 562 | NR1H3-1383-1449 | 27.33 | 3.23 |
| 179 | 563 | NR1H3-1384-1450 | 27.81 | 4.58 |
| 180 | 564 | NR1H3-1385-1451 | 44.36 | 4.37 |
| 181 | 565 | NR1H3-1387-1453 | 15.50 | 2.5 |
| 182 | 566 | NR1H3-1388-1454 | 46.03 | 6.42 |
| 183 | 567 | NR1H3-1391-1457 | 20.33 | 2.82 |
| 184 | 568 | NR1H3-1393-1459 | 27.25 | 2.95 |
| 185 | 569 | NR1H3-1394-1460 | 11.31 | 2.71 |
| 186 | 570 | NR1H3-1395-1461 | 30.82 | 3.24 |
| 187 | 571 | NR1H3-1396-1462 | 34.98 | 4.45 |
| 188 | 572 | NR1H3-1397-1463 | 41.12 | 4.28 |
| 189 | 573 | NR1H3-1398-1464 | 14.14 | 2.79 |
| 190 | 574 | NR1H3-1399-1465 | 14.46 | 2.61 |
| 191 | 575 | NR1H3-1400-1466 | 49.48 | 5.89 |
| 192 | 576 | NR1H3-1401-1467 | 21.19 | 3.39 |
| 193 | 577 | NR1H3-1402-1468 | 14.17 | 2.73 |
| 194 | 578 | NR1H3-1403-1469 | 18.25 | 1.29 |
| 195 | 579 | NR1H3-1404-1470 | 34.21 | 2.29 |
| 196 | 580 | NR1H3-1406-1472 | 46.79 | 7.22 |
| 197 | 581 | NR1H3-1407-1473 | 13.59 | 2.47 |
| 198 | 582 | NR1H3-1408-1474 | 44.63 | 5.37 |
| 199 | 583 | NR1H3-1410-1476 | 43.93 | 9.37 |
| 200 | 584 | NR1H3-1411-1477 | 28.12 | 4.11 |
| 201 | 585 | NR1H3-1412-1478 | 50.22 | 11.35 |
| 202 | 586 | NR1H3-1413-1479 | 45.56 | 6.23 |
| 203 | 587 | NR1H3-1414-1480 | 56.42 | 9.61 |
| 204 | 588 | NR1H3-1415-1481 | 32.43 | 10.32 |
| 205 | 589 | NR1H3-1416-1482 | 16.66 | 2.27 |
| 206 | 590 | NR1H3-1417-1483 | 31.84 | 4.71 |
| 207 | 591 | NR1H3-1418-1484 | 7.07 | 0.80 |
| 208 | 592 | NR1H3-1419-1485 | 69.83 | 8.81 |
| 209 | 593 | NR1H3-1420-1486 | 16.01 | 5.34 |
| 210 | 594 | NR1H3-1421-1487 | 38.29 | 6.31 |
| 211 | 595 | NR1H3-1422-1488 | 80.48 | 13.59 |
| 212 | 596 | NR1H3-1423-1489 | 9.79 | 1.47 |
| 213 | 597 | NR1H3-1424-1490 | 9.36 | 1.84 |
| 214 | 598 | NR1H3-1425-1491 | 22.14 | 3.77 |
| 215 | 599 | NR1H3-1426-1492 | 9.86 | 2.14 |
| 216 | 600 | NR1H3-1427-1493 | 18.88 | 6.80 |
| 217 | 601 | NR1H3-1428-1494 | 17.55 | 5.52 |
| 218 | 602 | NR1H3-1429-1495 | 2.77 | 1.08 |
| 219 | 603 | NR1H3-1430-1496 | 19.29 | 3.14 |
| 220 | 604 | NR1H3-1431-1497 | 8.66 | 3.71 |
| 221 | 605 | NR1H3-1432-1498 | 19.76 | 3.07 |
| 222 | 606 | NR1H3-1433-1499 | 3.37 | 2.29 |
| 223 | 607 | NR1H3-1434-1500 | 77.93 | 11.83 |
| 224 | 608 | NR1H3-1435-1501 | 14.53 | 5.77 |
| 225 | 609 | NR1H3-1436-1502 | 11.42 | 2.45 |
| 226 | 610 | NR1H3-1437-1503 | 4.97 | 1.57 |
| 227 | 611 | NR1H3-1438-1504 | 7.40 | 1.89 |
| 228 | 612 | NR1H3-1439-1505 | 3.26 | 0.97 |
| 229 | 613 | NR1H3-1440-1506 | 40.21 | 5.31 |
| 230 | 614 | NR1H3-1442-1508 | 50.09 | 3.47 |
| 231 | 615 | NR1H3-1443-1509 | 11.50 | 5.54 |
| 232 | 616 | NR1H3-1444-1510 | 29.36 | 15.66 |
| 233 | 617 | NR1H3-1445-1511 | 47.59 | 6.76 |
| 234 | 618 | NR1H3-1446-1512 | 2.37 | 0.65 |
| 235 | 619 | NR1H3-1447-1513 | 10.29 | 4.95 |
| 236 | 620 | NR1H3-1448-1514 | 45.74 | 4.52 |
| 237 | 621 | NR1H3-1449-1515 | 35.27 | 4.39 |
| 238 | 622 | NR1H3-1450-1516 | 39.10 | 5.63 |
| 239 | 623 | NR1H3-1451-1517 | 9.58 | 2.83 |
| 240 | 624 | NR1H3-1452-1518 | 64.45 | 15.14 |
| 241 | 625 | NR1H3-1453-1519 | 14.78 | 2.76 |
| 242 | 626 | NR1H3-1454-1520 | 5.01 | 2.14 |
| 243 | 627 | NR1H3-1455-1521 | 21.75 | 3.59 |
| 244 | 628 | NR1H3-1456-1522 | 9.11 | 2.01 |
| 245 | 629 | NR1H3-1457-1523 | 7.52 | 3.29 |
| 246 | 630 | NR1H3-1459-1525 | 7.81 | 1.75 |
| 247 | 631 | NR1H3-1460-1526 | 4.57 | 1.07 |
| 248 | 632 | NR1H3-1461-1527 | 30.77 | 4.42 |
| 249 | 633 | NR1H3-1462-1528 | 6.29 | 1.92 |
| 250 | 634 | NR1H3-1463-1529 | 2.58 | 0.85 |
| 251 | 635 | NR1H3-1465-1531 | 4.17 | 1.14 |
| 252 | 636 | NR1H3-1466-1532 | 15.04 | 1.90 |
| 253 | 637 | NR1H3-1468-1534 | 14.47 | 1.37 |
| 254 | 638 | NR1H3-1469-1535 | 14.04 | 2.26 |
| 255 | 639 | NR1H3-1471-1537 | 14.94 | 1.55 |
| 256 | 640 | NR1H3-1472-1538 | 45.97 | 3.01 |
| 257 | 641 | NR1H3-1473-1539 | 19.37 | 8.93 |
| 258 | 642 | NR1H3-1474-1540 | 9.53 | 2.70 |
| 259 | 643 | NR1H3-1475-1541 | 3.21 | 1.94 |
| 260 | 644 | NR1H3-1476-1542 | 11.27 | 4.12 |
| 261 | 645 | NR1H3-1477-1543 | 14.30 | 2.78 |
| 262 | 646 | NR1H3-1478-1544 | 13.06 | 3.66 |
| 263 | 647 | NR1H3-1479-1545 | 3.97 | 0.86 |
| 264 | 648 | NR1H3-1480-1546 | 4.82 | 1.41 |
| 265 | 649 | NR1H3-1481-1547 | 2.81 | 0.57 |
| 266 | 650 | NR1H3-1483-1549 | 5.56 | 1.60 |
| 267 | 651 | NR1H3-1484-1550 | 20.18 | 2.39 |
| 268 | 652 | NR1H3-1485-1551 | 3.52 | 2.10 |
| 269 | 653 | NR1H3-1486-1552 | 13.41 | 1.81 |
| 270 | 654 | NR1H3-1487-1553 | 25.35 | 3.42 |
| 271 | 655 | NR1H3-1488-1554 | 28.45 | 6.63 |
| 272 | 656 | NR1H3-1489-1555 | 15.31 | 5.00 |
| 273 | 657 | NR1H3-1491-1557 | 6.33 | 1.03 |
| 274 | 658 | NR1H3-1492-1558 | 20.75 | 4.42 |
| 275 | 659 | NR1H3-1494-1560 | 24.97 | 4.76 |
| 276 | 660 | NR1H3-1505-1571 | 38.74 | 5.88 |
| 277 | 661 | NR1H3-1507-1573 | 9.42 | 2.29 |
| 278 | 662 | NR1H3-1508-1574 | 36.57 | 6.54 |
| 279 | 663 | NR1H3-1509-1575 | 29.82 | 5.45 |
| 280 | 664 | NR1H3-1510-1576 | 19.45 | 3.79 |
| 281 | 665 | NR1H3-1511-1577 | 23.73 | 3.3 |
| 282 | 666 | NR1H3-1512-1578 | 42.41 | 7.68 |

TABLE 1-continued

In Vitro Screening Results

| SED ID NO (Sense Strand) | SED ID NO (Anti-sense Strand) | DsiRNA name | NR1H3-V1198 % remaining | SEM |
|---|---|---|---|---|
| 283 | 667 | NR1H3-1513-1579 | 33.80 | 5.58 |
| 284 | 668 | NR1H3-1514-1580 | 26.85 | 4.79 |
| 285 | 669 | NR1H3-1515-1581 | 3.95 | 0.84 |
| 286 | 670 | NR1H3-1516-1582 | 16.48 | 3.36 |
| 287 | 671 | NR1H3-1517-1583 | 4.38 | 1.57 |
| 288 | 672 | NR1H3-1518-1584 | 3.43 | 1.32 |
| 289 | 673 | NR1H3-1519-1585 | 5.73 | 1.72 |
| 290 | 674 | NR1H3-1520-1586 | 14.37 | 1.95 |
| 291 | 675 | NR1H3-1521-1587 | 15.60 | 9.44 |
| 292 | 676 | NR1H3-1522-1588 | 14.40 | 3.9 |
| 293 | 677 | NR1H3-1523-1589 | 9.60 | 2.11 |
| 294 | 678 | NR1H3-1525-1591 | 13.51 | 4.15 |
| 295 | 679 | NR1H3-1526-1592 | 50.59 | 16.74 |
| 296 | 680 | NR1H3-1527-1593 | 8.47 | 4.27 |
| 297 | 681 | NR1H3-1528-1594 | 25.44 | 3.59 |
| 298 | 682 | NR1H3-1529-1595 | 12.55 | 2.77 |
| 299 | 683 | NR1H3-1530-1596 | 11.6 | 3.15 |
| 300 | 684 | NR1H3-1531-1597 | 6.14 | 2.83 |
| 301 | 685 | NR1H3-1532-1598 | 15.35 | 4.55 |
| 302 | 686 | NR1H3-1533-1599 | 3.13 | 3 |
| 303 | 687 | NR1H3-1534-1600 | 8.51 | 3.07 |
| 304 | 688 | NR1H3-1535-1601 | 1.48 | 0.67 |
| 305 | 689 | NR1H3-1536-1602 | 30.02 | 10.69 |
| 306 | 690 | NR1H3-1537-1603 | 17.55 | 6.31 |
| 307 | 691 | NR1H3-1538-1604 | 21.90 | 1.81 |
| 308 | 692 | NR1H3-1539-1605 | 28.62 | 6.45 |
| 309 | 693 | NR1H3-1540-1606 | 19.29 | 5.08 |
| 310 | 694 | NR1H3-1541-1607 | 10.51 | 2.94 |
| 311 | 695 | NR1H3-1542-1608 | 8.39 | 6.98 |
| 312 | 696 | NR1H3-1543-1609 | 5.68 | 3.86 |
| 313 | 697 | NR1H3-1544-1610 | 23.78 | 4.02 |
| 314 | 698 | NR1H3-1545-1611 | 3.93 | 1.19 |
| 315 | 699 | NR1H3-1546-1612 | 11.55 | 1.89 |
| 316 | 700 | NR1H3-1547-1613 | 16.77 | 3.13 |
| 317 | 701 | NR1H3-1548-1614 | 10.86 | 7.45 |
| 318 | 702 | NR1H3-1549-1615 | 33.40 | 8.27 |
| 319 | 703 | NR1H3-1550-1616 | 13.98 | 3.23 |
| 320 | 704 | NR1H3-1551-1617 | 32.11 | 9.43 |
| 321 | 705 | NR1H3-1553-1619 | 43.83 | 11.06 |
| 322 | 706 | NR1H3-1554-1620 | 5.16 | 1.29 |
| 323 | 707 | NR1H3-1555-1621 | 89.05 | 22.10 |
| 324 | 708 | NR1H3-1556-1622 | 33.15 | 4.79 |
| 325 | 709 | NR1H3-1558-1624 | 15.27 | 4.11 |
| 326 | 710 | NR1H3-1559-1625 | 15.15 | 3.47 |
| 327 | 711 | NR1H3-1560-1626 | 34.65 | 4.83 |
| 328 | 712 | NR1H3-1561-1627 | 63.67 | 7.04 |
| 329 | 713 | NR1H3-1562-1628 | 16.78 | 10.54 |
| 330 | 714 | NR1H3-1563-1629 | 26.54 | 9.20 |
| 331 | 715 | NR1H3-1564-1630 | 34.34 | 14.27 |
| 332 | 716 | NR1H3-1565-1631 | 89.42 | 16.51 |
| 333 | 717 | NR1H3-1567-1633 | 66.56 | 5.80 |
| 334 | 718 | NR1H3-1569-1635 | 39.41 | 11.96 |
| 335 | 719 | NR1H3-1570-1636 | 25.11 | 4.45 |
| 336 | 720 | NR1H3-1572-1638 | 24.43 | 4.3 |
| 337 | 721 | NR1H3-1573-1639 | 13.36 | 2.16 |
| 338 | 722 | NR1H3-1574-1640 | 82.95 | 11.20 |
| 339 | 723 | NR1H3-1577-1643 | 35.42 | 6.60 |
| 340 | 724 | NR1H3-1579-1645 | 18.88 | 2.81 |
| 341 | 725 | NR1H3-1580-1646 | 21.56 | 5.67 |
| 342 | 726 | NR1H3-1581-1647 | 4.90 | 1.52 |
| 343 | 727 | NR1H3-1582-1648 | 10.89 | 3.83 |
| 344 | 728 | NR1H3-1583-1649 | 13.79 | 6.45 |
| 345 | 729 | NR1H3-1584-1650 | 16.62 | 7.10 |
| 346 | 730 | NR1H3-1585-1651 | 5.99 | 2.91 |
| 347 | 731 | NR1H3-1586-1652 | 3.86 | 0.94 |
| 348 | 732 | NR1H3-1587-1653 | 4.72 | 0.90 |
| 349 | 733 | NR1H3-1588-1654 | 2.35 | 0.39 |
| 350 | 734 | NR1H3-1589-1655 | 47.09 | 6.4 |
| 351 | 735 | NR1H3-1590-1656 | 12.18 | 2.49 |
| 352 | 736 | NR1H3-1591-1657 | 7.90 | 3.08 |
| 353 | 737 | NR1H3-1592-1658 | 13.57 | 3.13 |
| 354 | 738 | NR1H3-1593-1659 | 31.19 | 18.86 |
| 355 | 739 | NR1H3-1656-1720 | 31.57 | 13.68 |
| 356 | 740 | NR1H3-1657-1721 | 21.24 | 4.73 |
| 357 | 741 | NR1H3-1658-1722 | 15.81 | 4.89 |
| 358 | 742 | NR1H3-1659-1723 | 12.33 | 4.79 |
| 359 | 743 | NR1H3-1660-1724 | 22.98 | 7.43 |
| 360 | 744 | NR1H3-1661-1725 | 9.37 | 3.58 |
| 361 | 745 | NR1H3-1662-1726 | 8.29 | 2.01 |
| 362 | 746 | NR1H3-1663-1727 | 4.60 | 1.56 |
| 363 | 747 | NR1H3-1664-1728 | 16.48 | 1.97 |
| 364 | 748 | NR1H3-1665-1729 | 17.41 | 2.6 |
| 365 | 749 | NR1H3-1666-1730 | 23.86 | 4.49 |
| 366 | 750 | NR1H3-1667-1731 | 23.67 | 5.80 |
| 367 | 751 | NR1H3-1668-1732 | 27.34 | 4.76 |
| 368 | 752 | NR1H3-1669-1733 | 9.25 | 2.46 |
| 369 | 753 | NR1H3-1671-1735 | 5.99 | 1.88 |
| 370 | 754 | NR1H3-1677-1741 | 28.16 | 4.53 |
| 371 | 755 | NR1H3-1679-1743 | 10.30 | 2.96 |
| 372 | 756 | NR1H3-1680-1744 | 13.50 | 3.80 |
| 373 | 757 | NR1H3-1681-1745 | 12.10 | 2.74 |
| 374 | 758 | NR1H3-1682-1746 | 17.59 | 5.47 |
| 375 | 759 | NR1H3-1683-1747 | 17.57 | 14.50 |
| 376 | 760 | NR1H3-1684-1748 | 3.97 | 0.47 |
| 377 | 761 | NR1H3-1685-1749 | 7.55 | 2.88 |
| 378 | 762 | NR1H3-1686-1750 | 8.97 | 4.18 |
| 379 | 763 | NR1H3-1687-1751 | 16.24 | 8.75 |
| 380 | 764 | NR1H3-1728-1792 | 6.44 | 1.49 |
| 381 | 765 | NR1H3-1729-1793 | 8.96 | 3.52 |
| 382 | 766 | NR1H3-1730-1794 | 15.41 | 8.06 |
| 383 | 767 | NR1H3-1731-1795 | 5.40 | 2.04 |
| 384 | 768 | NR1H3-1732-1796 | 3.85 | 0.85 |

Example 3: GalNAc-Conjugated NRJH3 RNAi Oligonucleotides Inhibit Human NRJH3 In Vitro The in vitro screening assay in Example 2 validated the ability of NR1H3-targeting DsiRNA to knockdown NR1H3 mRNA. To further evaluate the ability of NR1H3 RNAi oligonucleotides to inhibit NR1H3 mRNA expression, GalNAc-conjugated NR1H3 oligonucleotides were generated using sequences identified by the algorithm in Example 2.

Specifically, a subset of the DsiRNAs identified by the algorithm were used to generate corresponding double-stranded RNAi oligonucleotides comprising a nicked tetraloop GalNAc-conjugated structure (referred to herein as "GalNAc-conjugated NR1H3 oligonucleotides" or "GalNAc-NR1H3 constructs") having a 36-mer passenger strand and a 22-mer guide strand (Table 3). Further, two nucleotide sequences comprising the passenger strand and guide strand have a distinct pattern of modified nucleotides and phosphorothioate linkages (sense strand SEQ ID Nos: 945-1032; antisense SEQ ID Nos:1037 and 1086). Three of the nucleotides comprising the tetraloop were each conjugated to a GalNAc moiety (CAS #14131-60-3). The modification pattern of each strand is illustrated below:

Sense Strand: 5'-mX-S-mX-mX-mX-mX-mX-mX-fX-fX-fX-fX[-mX-]$_{16}$-[ademX-GalNAc]-[ademX-GalNAc]-[ademX-GalNAc]-mX-mX-mX-mX-mX-mX-3'.

Hybridized to:

Antisense Strand: 5'-[MePhosphonate-4O-mX]-S-fX-S-fX-fX-fX-mX-fX-mX-mX-fX-mX-mX-mX-fX-mX-mX-mX-mX-mX-mX-S-mX-S-mX-3'.

(Modification key: Table 2 and [ademX-GalNAc]=GalNAc-conjugated nucleotide)
Or, represented as:
  Sense Strand: [mXs][mX][mX][mX][mX][mX][mX][fX][fX][fX][fX][mX][mX][mX][mX][mX][mX][mX][mX][mX][mX][mX][mX][mX][mX][mX][mX][ademA-GaNAc][ademA-GalNAc][ademA-GalNAc][mX][mX][mX][mX][mX][mX]
Hybridized to:
  Antisense Strand: [MePhosphonate-4O-mXs][fXs][fX][fX][fX][mX][fX][mX][mX][fX][mX][mX][mX][fX][mX][mX][mX][mX][mX][mXs][mXs][mX]
The remainder of the nucleotide sequences comprising the passenger strand and guide strand have a second distinct pattern of modified nucleotides and phosphorothioate linkages (sense strand SEQ ID Nos: 945-1032; antisense SEQ ID NOs: 1033-1036, 1038-1085 and 1087-1120). Three of the nucleotides comprising the tetraloop were each conjugated to a GalNAc moiety (CAS #14131-60-3). The modification pattern of each strand is illustrated below:
Sense Strand: 5'-mX-S-mX-mX-mX-mX-mX-mX-fX-fX-fX-fX[-mX-]16-[ademX-GalNAc]-[ademX-GalNAc]-[ademX-GalNAc]-mX-mX-mX-mX-mX-mX-3'.
Hybridized to:
Antisense Strand: 5'-[MePhosphonate-4O-mX]-S-fX-S-fX-S-fX-fX-mX-fX-mX-fX-mX-mX-mX-fX-mX-mX-mX-mX-mX-mX-S-mX-S-mX-3'.
(Modification key: Table 2 and [ademX-GalNAc]=GalNAc-conjugated nucleotide)
Or, represented as:
  Sense Strand: [mXs][mX][mX][mX][mX][mX][mX][fX][fX][fX][fX][mX][mX][mX][mX][mX][mX][mX][mX][mX][mX][mX][mX][mX][mX][mX][mX][ademA-GalNAc][ademA-GalNAc][ademA-GalNAc][mX][mX][mX][mX][mX][mX]
Hybridized to:
  Antisense Strand: [MePhosphonate-4O-mXs][fXs][fXs][fX][fX][mX][fX][mX][mX][fX][mX][mX][mX][fX][mX][mX][mX][mX][mX][mXs][mXs][mX]

TABLE 2

(Modification key:)

| Symbol | Modification/linkage |
|---|---|
| Key 1 | |
| mX | 2'-O-methyl modified nucleotide |
| fX | 2'-fluoro modified nucleotide |
| -S- | phosphorothioate linkage |
| - | phosphodiester linkage |
| [MePhosphonate-4O-mX] | 5'-methoxyphosphonate-4'-oxy modified nucleotide |
| ademA-GalNAc | GalNAc attached to an adenine nucleotide |
| Key 2 | |
| [mXs] | 2'-O-methyl modified nucleotide with a phosphorothioate linkage to the neighboring nucleotide |
| [fXs] | 2'-fluoro modified nucleotide with a phosphorothioate linkage to the neighboring nucleotide |
| [mX] | 2'-O-methyl modified nucleotide with phosphodiester linkages to neighboring nucleotides |
| [fX] | 2'-fluoro modified nucleotide with phosphodiester linkages to neighboring nucleotides |

GalNAc-NR1H3 constructs were used to evaluate inhibition efficacy in cells expressing human NR1H3. Specifically, Huh-7 cells were transfected with the GalNAc-NR1H3 constructs using methods described in Example 2. Results are provided in Table 3, which demonstrate successful knock-down of human NR1H3 mRNA with several constructs.

TABLE 3

GalNAc-Conjugated Human NR1H3 RNAi Oligonucleotides

| SED ID NO (modified Sense Strand) | SED ID NO (modified Antisense Strand) | DsiRNA name | % remaining | SEM |
|---|---|---|---|---|
| 945 | 1033 | NR1H3-763-783-860 | 109.29 | 17.94 |
| 946 | 1034 | NR1H3-765-785-862 | 57.30 | 15.34 |
| 947 | 1035 | NR1H3-767-787-864 | 31.55 | 7.72 |
| 948 | 1036 | NR1H3-768-788-865 | 89.93 | 18.03 |
| 949 | 1037 | NR1H3-769-789-866 | 18.84 | 4.39 |
| 950 | 1038 | NR1H3-794-814-891 | 40.26 | 12.66 |
| 951 | 1039 | NR1H3-1152-1172-1249 | 74.17 | 12.97 |
| 952 | 1040 | NR1H3-1189-1209-1286 | 47.09 | 11.14 |
| 953 | 1041 | NR1H3-1195-1215-1292 | 41.72 | 9.81 |
| 954 | 1042 | NR1H3-1200-1220-1297 | 102.50 | 25.27 |
| 955 | 1043 | NR1H3-1201-1221-1298 | 28.78 | 4.63 |
| 956 | 1044 | NR1H3-1202-1222-1299 | 16.81 | 5.40 |
| 957 | 1045 | NR1H3-1203-1223-1300 | 11.40 | 3.12 |
| 958 | 1046 | NR1H3-1204-1224-1301 | 10.27 | 9.33 |
| 959 | 1047 | NR1H3-1205-1225-1302 | 15.93 | 5.10 |
| 960 | 1048 | NR1H3-1206-1226-1303 | 59.82 | 14.86 |
| 962 | 1050 | NR1H3-1208-1228-1305 | 10.94 | 1.83 |
| 963 | 1051 | NR1H3-1209-1229-1306 | 101.62 | 23.09 |
| 964 | 1052 | NR1H3-1210-1230-1307 | 25.85 | 6.52 |
| 965 | 1053 | NR1H3-1211-1231-1308 | 29.68 | 4.19 |
| 966 | 1054 | NR1H3-1212-1232-1309 | 39.90 | 13.07 |
| 967 | 1055 | NR1H3-1213-1233-1310 | 15.16 | 4.91 |
| 968 | 1056 | NR1H3-1214-1234-1311 | 25.26 | 16.03 |
| 970 | 1058 | NR1H3-1221-1241-1318 | 23.77 | 6.65 |
| 973 | 1061 | NR1H3-1249-1269-1346 | 45.75 | 8.54 |
| 975 | 1063 | NR1H3-1254-1274-1351 | 36.79 | 10.59 |
| 976 | 1064 | NR1H3-1255-1275-1352 | 16.79 | 4.54 |
| 977 | 1065 | NR1H3-1256-1276-1353 | 55.93 | 16.15 |
| 978 | 1066 | NR1H3-1257-1277-1354 | 90.17 | 15.01 |
| 980 | 1068 | NR1H3-1260-1280-1357 | 17.80 | 2.89 |
| 981 | 1069 | NR1H3-1261-1281-1358 | 81.65 | 24.27 |
| 982 | 1070 | NR1H3-1263-1283-1360 | 15.12 | 5.37 |
| 983 | 1071 | NR1H3-1264-1284-1361 | 25.69 | 6.43 |
| 986 | 1074 | NR1H3-1405-1471-1502 | 40.51 | 10.03 |
| 987 | 1075 | NR1H3-1409-1475-1506 | 43.45 | 7.797 |
| 993 | 1081 | NR1H3-1458-1524-1555 | 6.54 | 1.345 |
| 995 | 1083 | NR1H3-1464-1530-1561 | 53.64 | 10.29 |
| 996 | 1084 | NR1H3-1465-1531-1562 | 33.78 | 10.83 |
| 997 | 1085 | NR1H3-1467-1533-1564 | 33.29 | 19.93 |
| 998 | 1086 | NR1H3-1469-1535-1566 | 20.17 | 7.60 |
| 999 | 1087 | NR1H3-1470-1536-1567 | 34.02 | 6.95 |
| 1002 | 1088 | NR1H3-1480-1546-1577 | 31.73 | 6.53 |
| 1004 | 1092 | NR1H3-1482-1548-1579 | 12.18 | 3.56 |
| 1009 | 1097 | NR1H3-1524-1590-1621 | 28.36 | 10.49 |
| 1018 | 1106 | NR1H3-1594-1660-1691 | 30.67 | 13.85 |
| 1019 | 1107 | NR1H3-1595-1661-1692 | 50.80 | 8.90 |
| 1020 | 1108 | NR1H3-1596-1662 | 56.02 | 19.49 |
| 1022 | 1110 | NR1H3-1670-1734 | 10.71 | 5.09 |
| 1024 | 1112 | NR1H3-1672-1736 | 25.94 | 11.33 |
| 1025 | 1113 | NR1H3-1673-1737 | 53.70 | 17.23 |
| 1026 | 1114 | NR1H3-1674-1738 | 14.48 | 2.82 |
| 1027 | 1115 | NR1H3-1675-1739-1766 | 55.04 | 10.59 |
| 1028 | 1116 | NR1H3-1676-1740-1767 | 33.47 | 12.90 |
| 1029 | 1117 | NR1H3-1678-1742-1769 | 364.22 | 31.30 |

Example 4: RNAi Oligonucleotide Inhibition of NR1H3 Expression in Mice In Vivo

The in vitro screening assays in Examples 2 and 3 validated the ability of NR1H3-targeting oligonucleotides to knock-down target mRNA. To confirm the ability of the RNAi oligonucleotides to knockdown NR1H3 in vivo, an HDI mouse model was used. Two sets of GalNAc-conjugated NR1H3 oligonucleotides were evaluated. Specifically, a set of GalNAc-conjugated NR1H3 oligonucleotides were generated from DsiRNA screened in Example 2 (as shown in Table 4) and the GalNAc-conjugated NR1H3 oligonucleotides from Example 3 (as shown in Table 5). Both sets of constructs were evaluated in mice engineered to transiently express human NR1H3 mRNA in hepatocytes of the mouse liver. Briefly, 6-8-week-old female CD-1 mice (n=4-5) were subcutaneously administered the indicated GalNAc-conjugated NR1H3 oligonucleotides at a dose of 2 mg/kg formulated in PBS. A control group of mice (n=5) were administered only PBS. Three days later (72 hours), the mice were hydrodynamically injected (HDI) with a DNA plasmid encoding the full human NR1H3 gene (25 µg) under control of a ubiquitous cytomegalovirus (CMV) promoter sequence. One day after introduction of the DNA plasmid, liver samples from HDI mice were collected. Total RNA derived from these HDI mice were subjected to qRT-PCR analysis to determine NR1H3 mRNA levels as described in Example 2. mRNA levels were measured for both human and mouse mRNA. The values were normalized for transfection efficiency using the NeoR gene included on the DNA plasmid.

TABLE 4

GalNAc-Conjugated Human NR1H3 RNAi Oligonucleotides for HDI screen

| | Unmodified Sense Strand (SED ID NO) | Unmodified Antisense strand (SED ID NO) | Modified Sense Strand (SED ID NO) | Modified Antisense strand (SED ID NO) |
|---|---|---|---|---|
| NR1H3-1207-1227 | 823 | 911 | 961 | 1049 |
| NR1H3-1220-1240 | 824 | 912 | 969 | 1057 |
| NR1H3-1224-1244 | 825 | 913 | 971 | 1059 |
| NR1H3-1244-1264 | 826 | 914 | 972 | 1060 |
| NR1H3-1252-1272 | 827 | 915 | 974 | 1062 |
| NR1H3-1259-1279 | 828 | 916 | 979 | 1067 |
| NR1H3-1265-1285 | 829 | 917 | 984 | 1072 |
| NR1H3-1266-1286 | 830 | 918 | 985 | 1073 |
| NR1H3-1429-1495 | 831 | 919 | 988 | 1076 |
| NR1H3-1433-1499 | 832 | 920 | 989 | 1077 |
| NR1H3-1437-1503 | 833 | 921 | 990 | 1078 |
| NR1H3-1439-1505 | 834 | 922 | 991 | 1079 |
| NR1H3-1446-1512 | 835 | 923 | 992 | 1080 |
| NR1H3-1463-1529 | 836 | 924 | 994 | 1082 |
| NR1H3-1475-1541 | 837 | 925 | 1000 | 1088 |
| NR1H3-1479-1545 | 838 | 926 | 1001 | 1089 |
| NR1H3-1481-1547 | 839 | 927 | 1003 | 1091 |
| NR1H3-1485-1551 | 840 | 928 | 1005 | 1093 |
| NR1H3-1515-1581 | 1537 | 929 | 1006 | 1094 |
| NR1H3-1517-1583 | 842 | 930 | 1007 | 1095 |
| NR1H3-1518-1584 | 843 | 931 | 1008 | 1096 |
| NR1H3-1533-1599 | 844 | 932 | 1010 | 1098 |
| NR1H3-1535-1601 | 845 | 933 | 1011 | 1099 |
| NR1H3-1545-1611 | 846 | 934 | 1012 | 1100 |
| NR1H3-1554-1620 | 847 | 935 | 1013 | 1101 |
| NR1H3-1581-1647 | 848 | 936 | 1014 | 1102 |
| NR1H3-1586-1652 | 849 | 937 | 1015 | 1103 |
| NR1H3-1587-1653 | 850 | 938 | 1016 | 1104 |
| NR1H3-1588-1654 | 851 | 939 | 1017 | 1105 |
| NR1H3-1663-1727 | 852 | 940 | 1021 | 1109 |
| NR1H3-1671-1735 | 853 | 941 | 1023 | 1111 |
| NR1H3-1684-1748 | 854 | 942 | 1030 | 1118 |
| NR1H3-1731-1795 | 855 | 943 | 1031 | 1119 |
| NR1H3-1732-1796 | 856 | 944 | 1032 | 1120 |

TABLE 5

GalNAc-Conjugated Human NR1H3 RNAi Oligonucleotides for HDI screen

| | Unmodified Sense Strand (SED ID NO) | Unmodified Antisense strand (SED ID NO) | Modified Sense Strand (SED ID NO) | Modified Antisense strand (SED ID NO) |
|---|---|---|---|---|
| NR1H3-763-783-860 | 769 | 857 | 945 | 1033 |
| NR1H3-765-785-862 | 770 | 858 | 946 | 1034 |
| NR1H3-767-787-864 | 771 | 859 | 947 | 1035 |
| NR1H3-768-788-865 | 772 | 860 | 948 | 1036 |
| NR1H3-769-789-866 | 773 | 861 | 949 | 1037 |
| NR1H3-794-814-891 | 774 | 862 | 950 | 1038 |
| NR1H3-1152-1172-1249 | 775 | 863 | 951 | 1039 |
| NR1H3-1189-1209-1286 | 776 | 864 | 952 | 1040 |
| NR1H3-1195-1215-1292 | 777 | 865 | 953 | 1041 |
| NR1H3-1200-1220-1297 | 778 | 866 | 954 | 1042 |
| NR1H3-1201-1221-1298 | 779 | 867 | 955 | 1043 |
| NR1H3-1202-1222-1299 | 780 | 868 | 956 | 1044 |
| NR1H3-1203-1223-1300 | 781 | 869 | 957 | 1045 |
| NR1H3-1204-1224-1301 | 782 | 870 | 958 | 1046 |
| NR1H3-1205-1225-1302 | 783 | 871 | 959 | 1047 |

TABLE 5-continued

GalNAc-Conjugated Human NR1H3 RNAi Oligonucleotides for HDI screen

| | Unmodified Sense Strand (SEQ ID NO) | Unmodified Antisense strand (SEQ ID NO) | Modified Sense Strand (SEQ ID NO) | Modified Antisense strand (SEQ ID NO) |
|---|---|---|---|---|
| NR1H3-1206-1226-1303 | 784 | 872 | 960 | 1048 |
| NR1H3-1208-1228-1305 | 785 | 873 | 962 | 1050 |
| NR1H3-1209-1229-1306 | 786 | 874 | 963 | 1051 |
| NR1H3-1210-1230-1307 | 787 | 875 | 964 | 1052 |
| NR1H3-1211-1231-1308 | 788 | 876 | 965 | 1053 |
| NR1H3-1212-1232-1309 | 789 | 877 | 966 | 1054 |
| NR1H3-1213-1233-1310 | 790 | 878 | 967 | 1055 |
| NR1H3-1214-1234-1311 | 791 | 879 | 968 | 1056 |
| NR1H3-1221-1241-1318 | 792 | 880 | 970 | 1058 |
| NR1H3-1249-1269-1346 | 793 | 881 | 973 | 1061 |
| NR1H3-1254-1274-1351 | 794 | 882 | 975 | 1063 |
| NR1H3-1255-1275-1352 | 795 | 883 | 976 | 1064 |
| NR1H3-1256-1276-1353 | 796 | 884 | 977 | 1065 |
| NR1H3-1257-1277-1354 | 797 | 885 | 978 | 1066 |
| NR1H3-1260-1280-1357 | 798 | 886 | 980 | 1068 |
| NR1H3-1261-1281-1358 | 799 | 887 | 981 | 1069 |
| NR1H3-1263-1283-1360 | 800 | 888 | 982 | 1070 |
| NR1H3-1264-1284-1361 | 801 | 889 | 983 | 1071 |
| NR1H3-1405-1471-1502 | 802 | 890 | 986 | 1074 |
| NR1H3-1409-1475-1506 | 803 | 891 | 987 | 1075 |
| NR1H3-1458-1524-1555 | 804 | 892 | 993 | 1081 |
| NR1H3-1464-1530-1561 | 805 | 893 | 995 | 1083 |
| NR1H3-1465-1531-1562 | 806 | 894 | 996 | 1084 |
| NR1H3-1467-1533-1564 | 807 | 895 | 997 | 1085 |
| NR1H3-1469-1535-1566 | 808 | 896 | 998 | 1086 |
| NR1H3-1470-1536-1567 | 809 | 897 | 999 | 1087 |
| NR1H3-1480-1546-1577 | 810 | 898 | 1002 | 1090 |
| NR1H3-1482-1548-1579 | 811 | 899 | 1004 | 1092 |
| NR1H3-1524-1590-1621 | 812 | 900 | 1009 | 1097 |
| NR1H3-1594-1660-1691 | 813 | 901 | 1018 | 1106 |
| NR1H3-1595-1661-1692 | 814 | 902 | 1019 | 1107 |
| NR1H3-1596-1662 | 815 | 903 | 1020 | 1108 |
| NR1H3-1670-1734 | 816 | 904 | 1022 | 1110 |
| NR1H3-1672-1736 | 817 | 905 | 1024 | 1112 |
| NR1H3-1673-1737 | 818 | 906 | 1025 | 1113 |
| NR1H3-1674-1738 | 819 | 907 | 1026 | 1114 |
| NR1H3-1675-1739-1766 | 820 | 908 | 1027 | 1115 |
| NR1H3-1676-1740-1767 | 821 | 909 | 1028 | 1116 |
| NR1H3-1678-1742-1769 | 822 | 910 | 1029 | 1117 |

Figure 1B:
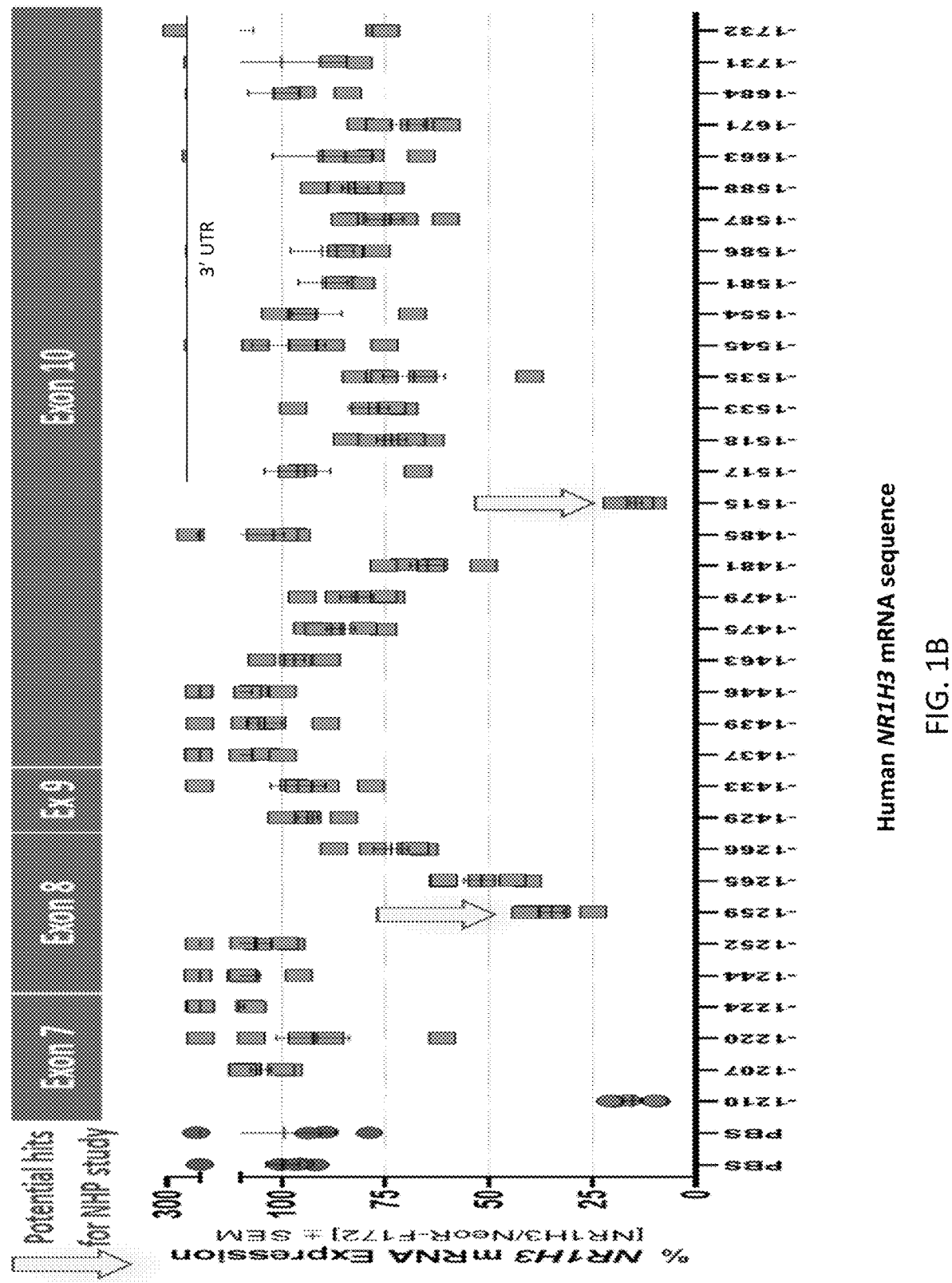
FIG. 1B provides a graph depicting the percent (%) remaining human NR1H3 mRNA in liver of mice exogenously expressing human NR1H3 (hydrodynamic injection model) after treatment with GalNAc-conjugated NR1H3 oligonucleotides. Three days post-dose mice were hydrodynamically injected (HDI) with the human NR1H3 mRNA construct. 18 hours later, livers were collected and human and mouse NR1H3 mRNA levels were measured. Exons indicate the location on the mRNA where the construct targets. Constructs tested in FIG. 1B were selected from the screen described in Example 2. White arrows indicate potential constructs for non-human primate (NHP) studies.
Figure 2:
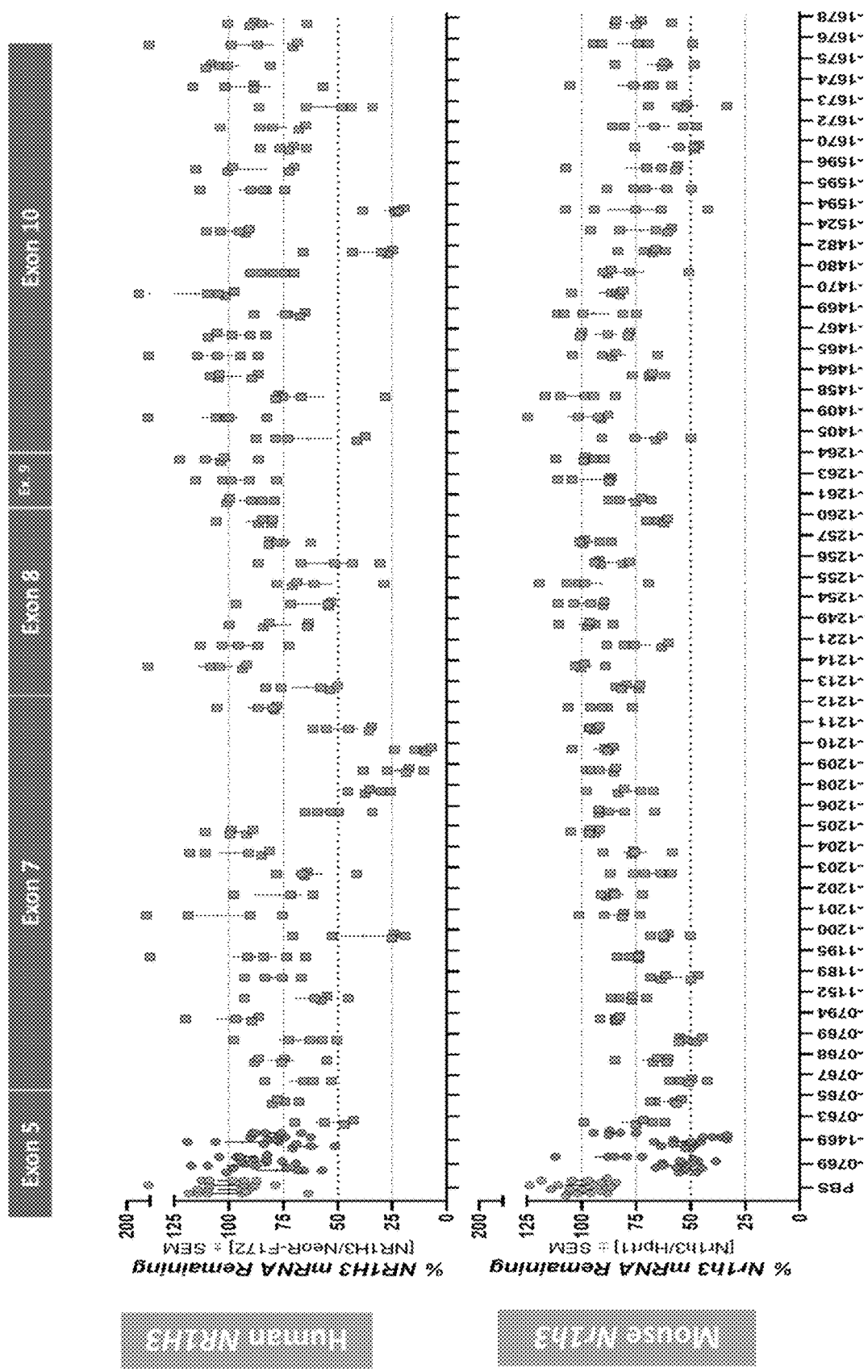
FIG. 2 provides graphs depicting the percentage (%) of remaining human or mouse NR1H3 mRNA in liver of mice exogenously expressing human NR1H3 (hydrodynamic injection model) after treatment with GalNAc-conjugated NR1H3 oligonucleotides designed based on sequences identified using the algorithm described in Example 2. Mice were dosed subcutaneously with 2 mg/kg of the indicated NR1H3-GalNAc construct. Three days post-dose mice were hydrodynamically injected (HDI) with the human NR1H3 mRNA construct. 18 hours later, livers were collected and human and mouse NR1H3 mRNA levels were measured. Exons indicate the location on the mRNA where the construct targets. Benchmark constructs (NR1H3-769 and NR1H3-1469) were selected from prior sequence screening conducted at Dicerna.

The results in FIG. 1B and FIG. 2 demonstrate that GalNAc-conjugated NR1H3 oligonucleotides designed to target human NR1H3 mRNA successfully inhibited human NR1H3 mRNA expression in HDI mice, as determined by a reduction in the amount of human NR1H3 mRNA expression in liver samples from HDI mice treated with GalNAc-conjugated NR1H3 oligonucleotides relative to control HDI mice treated with only PBS. Benchmark controls (NR1H3-769 and NR1H3-1469), which were selected from a prior sequence screening, were used to confirm successful knock-down.

Figure 3:
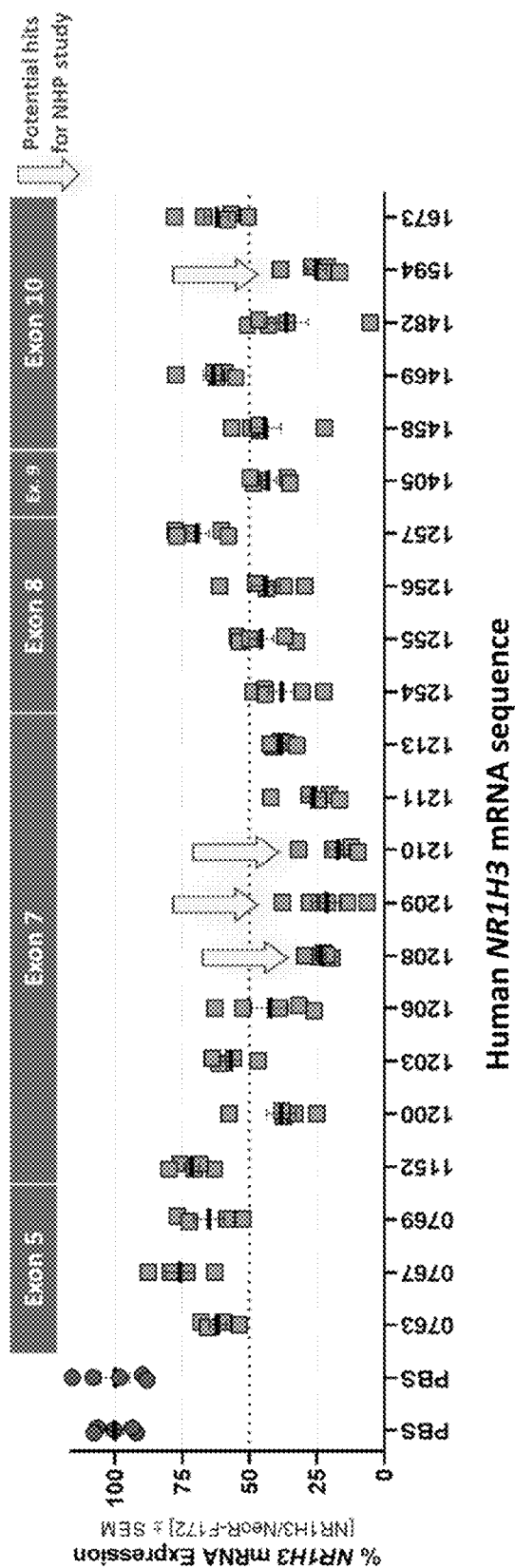
FIG. 3 provides a graph depicting the percent (%) remaining human NR1H3 mRNA in liver of mice exogenously expressing human NR1H3 (HDI model) after treatment with GalNAc-conjugated NR1H3 oligonucleotides. Constructs tested in FIG. 3 are a repeat assay validating the constructs tested in FIG. 2. White arrows indicate potential constructs for non-human primate studies.
Figure 4:
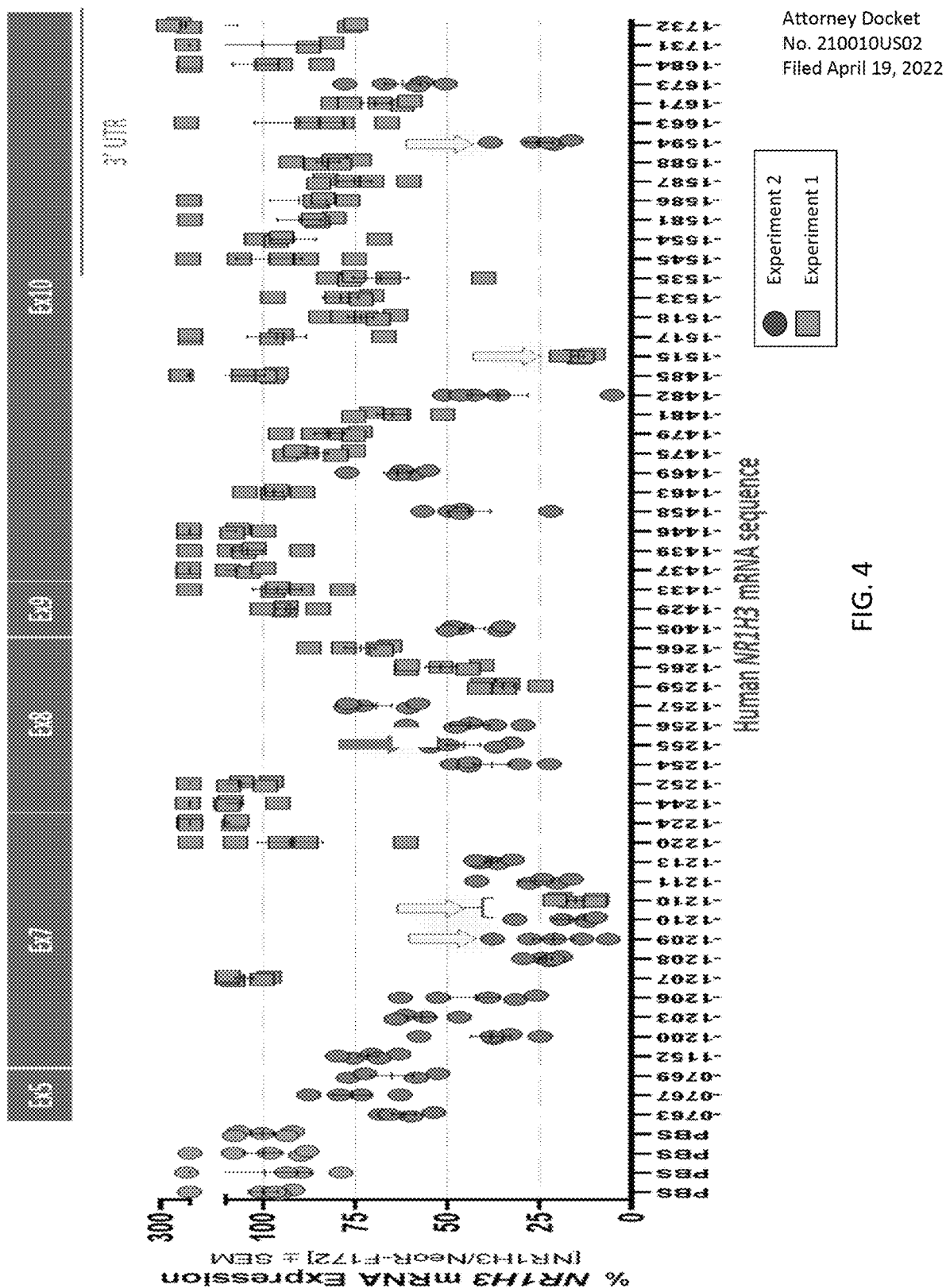
FIG. 4 provides a graph depicting the percent (%) remaining human NR1H3 mRNA in liver of mice exogenously expressing human NR1H3 (HDI model) after treatment with GalNAc-conjugated NR1H3 oligonucleotides. Constructs tested in FIG. 1B and FIG. 2 were validated and repeated in two assays (experiment 1 and experiment 2) using the same methods. White arrows indicate potential constructs for non-human primate studies.

The GalNAc-conjugated NR1H3 oligonucleotides tested in FIG. 1B and FIG. 2 were further validated in repeat assays as shown in FIGS. 3 and 4 using constructs from Table 4 and Table 5. The assays verified knock-down efficiency of each GalNAc-conjugated NR1H3 oligonucleotide, and four constructs were selected for further analysis in non-human primates (NHP).

Example 5: RNAi Oligonucleotide Inhibition of NR1H3 Expression in Non-Human Primates In Vivo Effective GalNAc-NR1H3 constructs identified in the HDI mouse studies were assayed for targeting efficiency in non-human primates. Specifically, GalNAc-conjugated NR1H3 oligonucleotides listed in Table 6 were evaluated in non-naïve cynomolgus monkeys (*Macaca fascicularis*).

TABLE 6

GalNAc Constructs evaluated in non-human primate

| | Modified Sense strand (SEQ ID NO) | Modified Antisense strand (SEQ ID NO) |
|---|---|---|
| NR1H3-1209-1229-1306 | 963 | 1051 |
| NR1H3-1210-1230-1307 | 964 | 1052 |
| NR1H3-1515-1581 | 1006 | 1094 |
| NR1H3-1594-1660-1691 | 1018 | 1106 |

Figure 5:
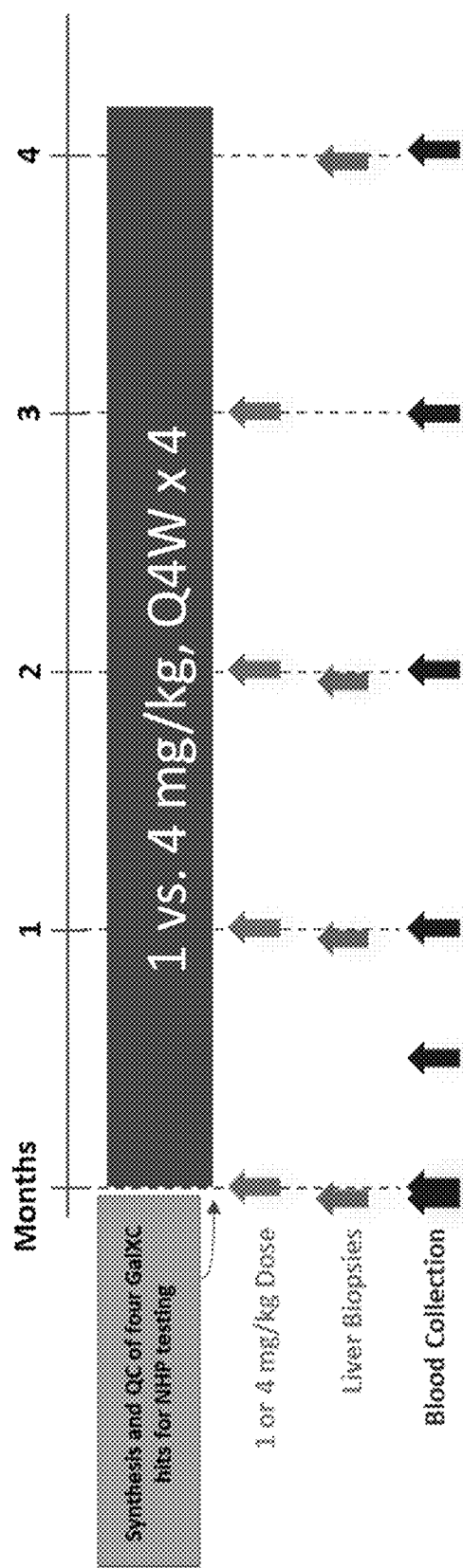
FIG. 5 provides a schematic depicting the dosing scheme and specimen collection for treatment of non-human primates with GalNAc-conjugated NR1H3 oligonucleotides. 1 mg/kg or 4 mg/kg are dosed once every 4 weeks for four months (Q4W×4). Timing for liver biopsies and blood collection is shown.

In this study, the monkeys were grouped so that their mean body weights (about 5.4 kg) were comparable between the control and experimental groups. Each cohort contained at least two female and at least two male subjects. The GalNAc-conjugated NR1H3 oligonucleotides were administered subcutaneously at a dose of 1 or 4 mg/kg on Study Day 0, 28, 56, and 112 as outlined in FIG. 5. Blood samples and liver biopsies were collected as outlined in Table 7 and FIG. 5.

TABLE 7

Treatment plan for NHP study

| Group | Dose (mg/kg) | Dosing | GalXC | DP Number | Blood Collection | Liver Biopsy | N |
|---|---|---|---|---|---|---|---|
| A | N/A | sc | PBS | N/A | −8, 0, 14, 28, 56, 112 | −8, 28, 56, 112 | 5 |
| B | 1 | sc | NR1H3-1209-1229-1306 | DP18987P: DP18986G | −8, 0, 14, 28, 56, 112 | 28, 56, 112 | 5 |
| C | 4 | sc | NR1H3-1209-1229-1306 | DP18987P: DP18986G | −8, 0, 14, 28, 56, 112 | −8, 28, 56, 112 | 5 |
| D | 1 | sc | NR1H3-1210-1230-1307 | DP18989P: DP18988G | −8, 0, 14, 28, 56, 112 | 28, 56, 112 | 5 |
| E | 4 | sc | NR1H3-1210-1230-1307 | DP18989P: DP18988G | −8, 0, 14, 28, 56, 112 | −8, 28, 56, 112 | 5 |
| F | 1 | sc | NR1H3-1515-1581 | DP20645P: DP20644G | −8, 0, 14, 28, 56, 112 | 28, 56, 112 | 5 |
| G | 4 | sc | NR1H3-1515-1581 | DP20645P: DP20644G | −8, 0, 14, 28, 56, 112 | −8, 28, 56, 112 | 5 |
| H | 1 | sc | NR1H3-1594-1660-1691 | DP19040P: DP19039G | −8, 0, 14, 28, 56, 112 | 28, 56, 112 | 4 |
| I | 4 | sc | NR1H3-1594-1660-1691 | DP19040P: DP19039G | −8, 0, 14, 28, 56, 112 | −8, 28, 56, 112 | 5 |

At each time point, total RNA derived from the liver biopsy samples was subjected to qRT-PCR analysis to measure NR1H3 mRNA in oligonucleotide-treated monkeys relative to those treated with a comparable volume of PBS. To normalize the data, the measurements were made relative to the reference gene, PPIB (Rh02802984_m1 (Taqman)). The following SYBR assays purchased from Integrated DNA Technologies were used to evaluate gene expressions: Forward-942: GTCTCTGTGCAGGAGATAGTTG (SEQ ID NO: 1517), Reverse-1399: GGAGGCTCACCAGTTT-CATTA (SEQ ID NO: 1518). As shown in Table 8 (Day 28), treating NHPs with the GalNAc-conjugated NR1H3 oligonucleotides listed in Table 6 inhibited NR1H3 expression in the liver, as determined by a reduced amount of NR1H3 mRNA in liver samples from oligonucleotide-treated NHPs relative to NHPs treated with PBS. Days 56 and 112 were also measured (Table 8). These results demonstrate that treating NHPs with the GalNAc-conjugated NR1H3 oligonucleotides reduces the amount of NR1H3 mRNA in the liver in a dose dependent manner.

TABLE 8

NR1H3 mRNA remaining after treatment with the indicated NR1H3-GalNAc in the liver from the oligonucleotide-treated NHP NR1H3 Gene Expression (% Time-Matched PBS)

Day 28

| | PBS | −1209 | | −1210 | | −1515 | | −1594 | |
|---|---|---|---|---|---|---|---|---|---|
| | | 1 mg/kg | 4 mg/kg | 1 mg/kg | 4 mg/kg | 1 mg/kg | 4 mg/kg | 1 mg/kg | 4 mg/kg |
| Animal 1 | 107.3 | 58.6 | 35.6 | 60.1 | 45.1 | 95.8 | 55.4 | 111.6 | 80.4 |
| Animal 2 | 116.6 | 62.4 | 27.8 | 48.5 | 34.7 | 101.3 | NS | 108.3 | 103.6 |
| Animal 3 | 122.1 | 79.4 | 44.5 | 73.8 | 35.7 | 111.8 | 74.1 | 145.5 | 45.9 |
| Animal 4 | 77.4 | 78.5 | 50.5 | 65.1 | 27.5 | 70.0 | 45.1 | 195.4 | 73.2 |
| Animal 5 | 76.6 | 89.2 | 37.4 | 77.5 | 45.2 | 78.9 | 34.9 | NS | 68.5 |
| Average | 100.0 | 73.6 | 39.2 | 65.0 | 37.6 | 91.6 | 52.4 | 140.2 | 74.3 |
| SEM | 9.7 | 5.7 | 3.9 | 5.1 | 3.4 | 7.6 | 8.4 | 20.2 | 9.3 |

Day 56

| | PBS | −1209 | | −1210 | | −1515 | | −1594 | |
|---|---|---|---|---|---|---|---|---|---|
| | | 1 mg/kg | 4 mg/kg | 1 mg/kg | 4 mg/kg | 1 mg/kg | 4 mg/kg | 1 mg/kg | 4 mg/kg |
| Animal 1 | 96.7 | 72.9 | 29.0 | 43.7 | 39.0 | 59.7 | 30.0 | 67.7 | 78.2 |
| Animal 2 | 115.0 | 60.1 | 29.7 | 75.9 | 32.1 | 68.7 | NS | 85.1 | 103.4 |
| Animal 3 | 87.1 | 52.7 | 32.6 | 36.8 | 40.4 | 48.1 | 45.0 | 104.3 | 70.0 |
| Animal 4 | 103.4 | 34.9 | 45.0 | 51.9 | 26.9 | 43.6 | 37.3 | 76.2 | 72.1 |
| Animal 5 | 97.8 | 45.9 | 32.3 | 55.9 | 36.0 | 47.1 | 31.1 | NS | 72.4 |
| Average | 100.0 | 53.3 | 33.7 | 52.8 | 34.9 | 53.4 | 35.9 | 83.3 | 79.2 |
| SEM | 4.6 | 6.4 | 2.9 | 6.6 | 2.5 | 4.7 | 3.4 | 7.8 | 6.2 |

TABLE 8-continued

NR1H3 mRNA remaining after treatment with the indicated NR1H3-GalNAc in the liver from the oligonucleotide-treated NHP

| | | NR1H3 Gene Expression (% Time-Matched PBS) | | | | | | | |
|---|---|---|---|---|---|---|---|---|---|
| | | Day 112 | | | | | | | |
| | | −1209 | | −1210 | | −1515 | | −1594 | |
| | PBS | 1 mg/kg | 4 mg/kg | 1 mg/kg | 4 mg/kg | 1 mg/kg | 4 mg/kg | 1 mg/kg | 4 mg/kg |
| Animal 1 | 113.2 | 44.2 | 27.3 | 34.4 | 33.1 | 52.8 | 46.8 | 56.6 | 34.8 |
| Animal 2 | 106.6 | 56.2 | 21.7 | 42.8 | 33.0 | 36.2 | NS | 57.9 | 31.2 |
| Animal 3 | 100.2 | 59.6 | 22.1 | 33.4 | 29.6 | 46.2 | 45.7 | 48.5 | 44.2 |
| Animal 4 | 103.1 | 47.8 | 45.0 | 44.9 | 33.1 | 44.1 | 44.9 | 65.7 | 32.1 |
| Animal 5 | 77.0 | 55.9 | 34.4 | 45.3 | 32.1 | 52.6 | 37.6 | NS | 33.6 |
| Average | 100.0 | 52.7 | 30.1 | 40.2 | 32.2 | 46.4 | 43.8 | 57.2 | 35.2 |
| SEM | 6.2 | 2.9 | 4.4 | 2.6 | 0.7 | 3.1 | 2.1 | 3.5 | 2.3 |

NS = no sample

To confirm if the GalNAc conjugated NR1H3 were specific targeting NR1H3, both NR1H3 and NR1H2 expression was evaluated in liver samples. Non-human primates treated with 4 mg/kg of GalNAc-conjugated NR1H3 were assayed for expression at days 0, 28, 56, and 112 in the liver for knock-down (KD) of NR1H3 mRNA in (Table 9), and NR1H2 (Table 10). The results demonstrate that the constructs are specific to NR1H3 and do not have significant off target effects for NR1H2.

TABLE 9

NR1H3 mRNA remaining after treatment with the indicated NR1H3-GalNAc in NHP

| | NR1H3 Gene Expression (% Time Matched PBS) 4 mg/kg | | | | |
|---|---|---|---|---|---|
| | PBS | −1209 | −1210 | −1515 | −1594 |
| | Day −6 | | | | |
| Animal 1 | 65.8 | 136.6 | 204.3 | 103.8 | NS |
| Animal 2 | 102.4 | 78.1 | 113.3 | 49.3 | 80.3 |
| Animal 3 | 86.1 | 101.0 | 150.2 | 94.0 | 104.3 |
| Animal 4 | 137.3 | 89.9 | 155.0 | 82.8 | 109.7 |
| Animal 5 | 108.4 | 90.8 | 92.5 | 83.1 | 124.2 |
| Average | 100.0 | 99.3 | 143.1 | 82.6 | 104.6 |
| SEM | 11.9 | 10.0 | 19.2 | 9.2 | 9.1 |
| | Day 28 | | | | |
| Animal 1 | 107.3 | 35.6 | 45.1 | 55.4 | 80.4 |
| Animal 2 | 116.6 | 27.8 | 34.7 | NS | 103.6 |
| Animal 3 | 122.1 | 44.5 | 35.7 | 74.1 | 45.9 |
| Animal 4 | 77.4 | 50.5 | 27.5 | 45.1 | 73.2 |
| Animal 5 | 76.6 | 37.4 | 45.2 | 34.9 | 68.5 |
| Average | 100.0 | 39.2 | 37.6 | 52.4 | 74.3 |
| SEM | 9.7 | 3.9 | 3.4 | 8.4 | 9.3 |
| | Day 56 | | | | |
| Animal 1 | 96.7 | 29.0 | 39.0 | 30.0 | 78.2 |
| Animal 2 | 115.0 | 29.7 | 32.1 | NS | 103.4 |
| Animal 3 | 87.1 | 32.6 | 40.4 | 45.0 | 70.0 |
| Animal 4 | 103.4 | 45.0 | 26.9 | 37.3 | 72.1 |
| Animal 5 | 97.8 | 32.3 | 36.0 | 31.1 | 72.4 |
| Average | 100.0 | 33.7 | 34.9 | 35.9 | 79.2 |
| SEM | 4.6 | 2.9 | 2.5 | 3.4 | 6.2 |
| | Day 112 | | | | |
| Animal 1 | 113.2 | 27.3 | 33.1 | 46.8 | 34.8 |
| Animal 2 | 106.6 | 21.7 | 33.0 | NS | 31.2 |
| Animal 3 | 100.2 | 22.1 | 29.6 | 45.7 | 44.2 |
| Animal 4 | 103.1 | 45.0 | 33.1 | 44.9 | 32.1 |
| Animal 5 | 77.0 | 34.4 | 32.1 | 37.6 | 33.6 |

TABLE 9-continued

NR1H3 mRNA remaining after treatment with the indicated NR1H3-GalNAc in NHP

| | NR1H3 Gene Expression (% Time Matched PBS) 4 mg/kg | | | | |
|---|---|---|---|---|---|
| | PBS | −1209 | −1210 | −1515 | −1594 |
| Average | 100.0 | 30.1 | 32.2 | 43.8 | 35.2 |
| SEM | 6.2 | 4.4 | 0.7 | 2.1 | 2.3 |

NS = no sample

TABLE 10

NR1H2 mRNA remaining after treatment with the indicated NR1H3-GalNAc in NHP

| | NR1H2 Gene Expression (% Time Matched PBS) 4 mg/kg | | | | |
|---|---|---|---|---|---|
| | PBS | −1209 | −1210 | −1515 | −1594 |
| | Day −6 | | | | |
| Animal 1 | 119.7 | 84 | 324.9 | 79.8 | NS |
| Animal 2 | 96.3 | 107.5 | 116.1 | 89.3 | 175.9 |
| Animal 3 | 105.7 | 86.2 | 106.6 | 103 | 151.1 |
| Animal 4 | 82.1 | 105.7 | 672 | 127.9 | 113.2 |
| Animal 5 | 96.3 | 134.9 | 126.7 | 101.6 | 113.9 |
| Average | 100.0 | 103.7 | 269.3 | 100.3 | 138.5 |
| SEM | 6.2 | 9.2 | 108.5 | 8.1 | 15.3 |
| | Day 28 | | | | |
| Animal 1 | 101 | 80.2 | 122.2 | 102.7 | 117.5 |
| Animal 2 | 123.3 | 80.9 | 103.7 | NS | 130 |
| Animal 3 | 111.8 | 78.1 | 107.3 | 87.8 | 61.2 |
| Animal 4 | 88.5 | 120.4 | 113.7 | 98.3 | 80.2 |
| Animal 5 | 75.3 | 129.4 | 102.7 | 97.1 | 75.4 |
| Average | 100.0 | 97.8 | 109.9 | 96.5 | 92.9 |
| SEM | 8.4 | 11.2 | 3.6 | 3.1 | 13.1 |
| | Day 56 | | | | |
| Animal 1 | 118.5 | 127.9 | 119.2 | 90.9 | 88.5 |
| Animal 2 | 118.4 | 98.6 | 99.6 | NS | 112 |
| Animal 3 | 90.9 | 91 | 131.8 | 76.3 | 103 |
| Animal 4 | 88.5 | 115.4 | 117.8 | 100.7 | 121.1 |
| Animal 5 | 83.8 | 107.6 | 87.1 | 85.5 | 119.4 |
| Average | 100.0 | 108.1 | 111.1 | 88.4 | 108.8 |
| SEM | 7.6 | 6.4 | 7.9 | 5.1 | 6.0 |
| | Day 112 | | | | |
| Animal 1 | 105.6 | 114.2 | 107.9 | 95.6 | 89.6 |
| Animal 2 | 108.5 | 81.5 | 106.8 | NS | 80.8 |
| Animal 3 | 119.1 | 76.7 | 118.4 | 90.5 | 96.8 |

TABLE 10-continued

NR1H2 mRNA remaining after treatment with the indicated NR1H3-GalNAc in NHP

| | NR1H2 Gene Expression (% Time Matched PBS) 4 mg/kg | | | | |
|---|---|---|---|---|---|
| | PBS | -1209 | -1210 | -1515 | -1594 |
| Animal 4 | 100.4 | 121.1 | 97.2 | 95.4 | 98.6 |
| Animal 5 | 66.4 | 99.1 | 104.8 | 111.9 | 98.1 |
| Average | 100.0 | 98.5 | 107.0 | 98.4 | 92.8 |
| SEM | 8.9 | 8.7 | 3.4 | 4.7 | 3.4 |

Taken together, these results show that GalNAc-conjugated NR1H3 oligonucleotides designed to target human NR1H3 mRNA inhibit total NR1H3 expression in vivo (as determined by the reduction of the amount of NR1H3 mRNA).

Example 6

In order to determine the effect of hepatic NR1H3 knockdown on liver and plasma triglycerides and total plasma cholesterol, C57Bl mice fed a high fat, high fructose, high cholesterol (HFFC-NASH) diet were administrated a NR1H3 GalNac siRNA probe specifically designed to reduce NR1H3 expression in mice. The compound was administrated by subcutaneous injection 3 mg/kg once a week for 4 weeks. The respective vehicle treated groups (chow and HFFC-NASH diet) were treated with PBS.

As seen in Table 11, hepatocyte specific knockdown (KD) of murine NR1H3-specific GalNac siRNA led to a significant decrease in murine NR1H3 transcript expression in the liver of treated animals as compared to vehicle. Treatment leading to such hepatic NR1H3 mRNA reduction in turn induced reductions in liver triglycerides, plasma triglyceride and plasma total cholesterol. Furthermore, genes involved in hepatic de novo lipogenesis (fatty acid synthase (Fasn) and Acetyl-CoA carboxylase 2 (Acc2)) were decreased by treatment with the murine NR1H3-specific GalNac siRNA. In conclusion, hepatocyte-specific knockdown of NR1H3 mRNA in a mouse model for NAFLD led to significant improvement in NASH related dyslipidemia.

TABLE 11

| | CHOW diet AVG ± ST. DEV. | NASH AVG ± ST. DEV. | NASH diet/NR1H3 KD AVG ± ST. DEV. | p-value NASH/ NASH NR1H3 KD |
|---|---|---|---|---|
| Liver triglycerides mg/g liver | 9.39 ± 2.88 | 47.00 ± 12.56 | 19.39 ± 11.07 | <0.0001 |
| Plasma triglycerides mM | 1.31 ± 0.31 | 0.86 ± 0.21 | 0.46 ± 0.11 | 0.0036 |
| Plasma total cholesterol mM | 2.06 ± 0.21 | 4.19 ± 0.54 | 3.37 ± 0.67 | 0.0145 |
| NR1H3 mRNA expression | 100 ± 5.27 | 106.19 ± 8.75 | 43.88 ± 6.27 | <0.0001 |
| Fasn mRNA expression | 100 ± 44.53 | 56.60 ± 27.23 | 17.58 ± 6.06 | 0.0327 |
| Acc2 mRNA expression | 100 ± 20.30 | 43.34 ± 21.89 | 12.21 ± 4.31 | 0.0034 |

Example 7: GalNAc-Conjugated siRNA Targeting NR1H3 for Knock Down in Obese Rhesus Monkeys Fed a High Cholesterol Diet A GalNAc-conjugated NR1H3 oligonucleotide (sense strand SEQ ID NO: 964 antisense strand SEQ ID NO: 1052) was administered to obese rhesus monkeys fed a high cholesterol diet (0.06% cholesterol). Eight obese rhesus monkeys fed a high cholesterol diet (0.06% cholesterol) for more than 4 years, and with a body weight ranging from 8-25 kg, were dosed with 4 mg/kg lead at weeks 0, 4 and 8 and study was terminated at week 12. A liver biopsy (week −3) and an ultrasound scan of the liver (week −1) were performed prior to dosing of the animals. Liver enzymes and plasma lipids were determined prior to dosing and every 2 weeks posttreatment to assess potential adverse effects. At the end of the study, liver and plasma samples were collected to measure the effect of NR1H3a knock down on lipid and cholesterol metabolism, hepatic genes involved in these pathways, as well as liver histology.

At the end of the study NR1H3a mRNA in the liver was decreased 50%. mRNA is calculated as A/A Ct levels relative to 18s gene expression in each sample. As NR1H3a is expressed in other liver cells, e.g. the Kupffer cells, a full knockdown of NR1H3a was not expected from a liver homogenate.

The plasma levels of liver enzymes and plasma levels of lipids are presented in Table 12. During the treatment period, there was no change in the plasma level of alanine aminotransferase (ALT), gamma-glutamyltransferase (GGT) or total bilirubin (TB), while a small increase was observed in aspartate aminotransferase (AST) after 8 and 10 weeks of treatment. During the treatment period, there was no change in the plasma level total cholesterol (TC) or low-density lipoprotein cholesterol (LDL C), while a significant increase in high-density lipoprotein cholesterol (HDL C) was observed already after 2 weeks of treatment. After 12 weeks of treatment a significant decrease in plasma triglycerides (TG) was observed. In Table 12, data represent mean±standard error of the mean. Baseline is the average of measures from week −4 to week 0 (pre-dose). Statistics are done relative to baseline: One-Way ANOVA. P*<0.05 P<0.01, P*<0.001.

TABLE 12

Liver enzymes and plasma lipids in response to NR1H3a KD in obese rhesus monkeys.

| | AST (IU/L) | ALT (IU/L) | GGT (IU/L) | TBili (mg/dL) | Plasma TG (mg/dL) | Plasma Total Cholesterol (mg/dL) | HDL-C (mg/dL) | LDL-C (mg/dL) |
|---|---|---|---|---|---|---|---|---|
| Baseline | 31.9 ± 1.5 | 55.6 ± 7.1 | 55.1 ± 4.2 | 0.21 ± 0.01 | 110 ± 19 | 206 ± 21.9 | 80 ± 4.6 | 107 ± 17.3 |
| Week 2 | 32.9 ± 2.9 | 58.4 ± 6.2 | 55.6 ± 5.2 | 0.17 ± 0.03 | 84.9 ± 10.3 | 209 ± 20 | 98 ± 6.0** | 98 ± 14.5 |
| Week 4 | 36.6 ± 4.1 | 68.9 ± 9.3 | 58.0 ± 3.8 | 0.18 ± 0.02 | 103 ± 20.2 | 210 ± 15 | 107 ± 4.3*** | 101 ± 10.8 |

TABLE 12-continued

Liver enzymes and plasma lipids in response to NR1H3a KD in obese rhesus monkeys.

|  | AST (IU/L) | ALT (IU/L) | GGT (IU/L) | TBili (mg/dL) | Plasma TG (mg/dL) | Plasma Total Cholesterol (mg/dL) | HDL-C (mg/dL) | LDL-C (mg/dL) |
|---|---|---|---|---|---|---|---|---|
| Week 6 | 38.5 ± 3.2 | 66.3 ± 6.0 | 49.9 ± 3.2 | 0.23 ± 0.02 | 74.1 ± 6.7 | 208 ± 16 | 102 ± 6.4** | 98 ± 9.8 |
| Week 8 | 42.5 ± 2.5*** | 70.4 ± 9.0 | 54.1 ± 4.5 | 0.15 ± 0.02* | 93.3 ± 18.0 | 211 ± 14 | 105 ± 6.2** | 104 ± 9.4 |
| Week 10 | 39.5 ± 2.8** | 58.5 ± 3.7 | 60.0 ± 3.3 | 0.17 ± 0.02 | 91.6 ± 12.4 | 219 ± 15 | 107 ± 4.9** | 105 ± 10.4 |
| Week 12 | 36.1 ± 2.1 | 59.3 ± 7.0 | 62.8 ± 3.5 | 0.16 ± 0.02* | 84.9 ± 17.2* | 214 ± 14 | 108 ± 4.3** | 116 ± 11.1 |

The effect of NR1H3a knock down on liver triglycerides and liver cholesterol is presented in Table 13. No significant change in liver triglycerides or cholesterol was observed. However, a tendency (p=0.055, paired t-test) towards a decrease in liver stiffness as measured by FibroScan™ was observed in response to hepatic NR1H3a knock down. In Table 13 data represent mean±standard error of the mean analyzed by a paired t-test. One monkey was excluded from the FibroScan™ analysis as it was not fully sedated during the second scan.

TABLE 13

TG and cholesterol levels and FibroScan ™ liver stiffness in obese rhesus monkeys

|  | Baseline | Week 13-14 |
|---|---|---|
| Liver triglycerides (mg/dL) | 40.9 ± 6.6 | 40.0 ± 5.5 |
| Liver cholesterol (mg/dL) | 42.6 ± 3.9 | 41.4 ± 3.0 |
| Liver stiffness kPa | 5.7 ± 0.5 | 4.3 ± 0.2 |

From the study, it can be concluded that knockdown of NR1H3a in hepatocytes does not cause hepatic cholesterol accumulation in obese monkeys fed a high cholesterol diet. An increased in plasma HDL C was observed 2 weeks after dosing, while a lowering of plasma TG was observed at week 12. No effect on liver TG was observed but none of the monkeys had steatosis at the start of the study. However, a tendency toward a decrease in liver stiffness was observed in response to hepatic NR1H3a knockdown.

List of Embodiments

Embodiment 1. An RNAi oligonucleotide for reducing NR1H3 expression, the oligonucleotide comprising a sense strand and an antisense strand, wherein the sense strand and the antisense strand form a duplex region, wherein the antisense strand comprises a region of complementarity to a NR1H3 mRNA target sequence of any one of SEQ ID NOs: 1-384, and wherein the region of complementarity is at least 15 contiguous nucleotides in length.
Embodiment 2. The RNAi oligonucleotide of embodiment 1, wherein the sense strand is 15 to 50 nucleotides in length.
Embodiment 3. The RNAi oligonucleotide of embodiments 1 or 2, wherein the sense strand is 18 to 36 nucleotides in length.
Embodiment 4. The RNAi oligonucleotide of any one of embodiments 1 to 3, wherein the antisense strand is 15 to 30 nucleotides in length.
Embodiment 5. The RNAi oligonucleotide of any one of embodiments 1 to 4, wherein the antisense strand is 22 nucleotides in length and wherein antisense strand and the sense strand form a duplex region of at least 19 nucleotides in length, optionally at least 20 nucleotides in length.
Embodiment 6. The RNAi oligonucleotide of any one of embodiments 1 to 5, wherein the region of complementarity is at least 19 contiguous nucleotides in length, optionally at least 20 nucleotides in length.
Embodiment 7. The RNAi oligonucleotide of any one of embodiments 1 to 6, wherein the 3' end of the sense strand comprises a stem-loop set forth as S1-L-S2, wherein S1 is complementary to S2, and wherein L forms a loop between S1 and S2 of 3-5 nucleotides in length.
Embodiment 8. An RNAi oligonucleotide for reducing NR1H3 expression, the oligonucleotide comprising a sense strand of 15 to 50 nucleotides in length and an antisense strand, wherein the sense strand and the antisense strand form a duplex region, wherein the wherein the antisense strand comprises a region of complementarity to a NR1H3 mRNA target sequence of any one of SEQ ID NOs: 1-384, and wherein the region of complementarity is at least 15 contiguous nucleotides in length.
Embodiment 9. An RNAi oligonucleotide for reducing NR1H3 expression, the oligonucleotide comprising a sense strand of 15 to 50 nucleotides in length and an antisense strand of 15 to 30 nucleotides in length, wherein the sense strand and the antisense strand form a duplex region, wherein the antisense strand comprises a region of complementarity to a NR1H3 mRNA target sequence of any one of SEQ ID NOs: 1-384, and wherein the region of complementarity is at least 15 contiguous nucleotides in length.
Embodiment 10. An RNAi oligonucleotide for reducing NR1H3 expression, the oligonucleotide comprising a sense strand of 15 to 50 nucleotides in length and an antisense strand, wherein the sense strand and the antisense strand form a duplex region, wherein the antisense strand comprises a region of complementarity to a NR1H3 mRNA target sequence of any one of SEQ ID NOs: 1-384, and wherein the region of complementarity is 19 contiguous nucleotides in length, optionally 20 nucleotides in length.
Embodiment 11. An RNAi oligonucleotide for reducing NR1H3 expression, the oligonucleotide comprising a sense strand of 18 to 36 nucleotides in length and an antisense strand, wherein the sense strand and the antisense strand form a duplex region, wherein the antisense strand comprises a region of complementarity to a NR1H3 mRNA target sequence of any one of SEQ ID NOs: 1-384, and wherein the region of complementarity is 19 contiguous nucleotides in length, optionally 20 nucleotides in length.
Embodiment 12. An RNAi oligonucleotide for reducing NR1H3 expression, the oligonucleotide comprising a sense strand of 18 to 36 nucleotides in length and an antisense strand of 22 nucleotides in length, wherein the sense strand and the antisense strand form a duplex region, wherein the antisense strand comprises a region of complementarity to a NR1H3 mRNA target sequence of any one of SEQ ID NOs:

1-384, and wherein the region of complementarity is 19 contiguous nucleotides in length, optionally 20 nucleotides in length.

Embodiment 13. An RNAi oligonucleotide for reducing NR1H3 expression, the oligonucleotide comprising a sense strand of 18 to 36 nucleotides in length and an antisense strand of 22 nucleotides in length, wherein the sense strand and the antisense strand form a duplex region, wherein the 3' end of the sense strand comprises a stem-loop set forth as S1-L-S2, wherein S1 is complementary to S2, and wherein L forms a loop between S1 and S2 of 3-5 nucleotides in length, wherein the antisense strand comprises a region of complementarity to a NR1H3 mRNA target sequence of any one of SEQ ID NOs: 1-384, and wherein the region of complementarity is 19 contiguous nucleotides in length, optionally 20 nucleotides in length.

Embodiment 14. An RNAi oligonucleotide for reducing NR1H3 expression, the oligonucleotide comprising a sense strand of 36 nucleotides in length and an antisense strand of 22 nucleotides in length, wherein the sense strand and the antisense strand form a duplex region, wherein the 3' end of the sense strand comprises a stem-loop set forth as S1-L-S2, wherein S1 is complementary to S2, and wherein L forms a loop between S1 and S2 of 3-5 nucleotides in length, wherein the antisense strand comprises a region of complementarity to a NR1H3 mRNA target sequence of any one of SEQ ID NOs: 1-384, and wherein the region of complementarity is 19 contiguous nucleotides in length, optionally 20 nucleotides in length.

Embodiment 15. An RNAi oligonucleotide for reducing NR1H3 expression, the oligonucleotide comprising a sense strand of 36 nucleotides in length and an antisense strand of 22 nucleotides in length, wherein the sense strand and the antisense strand form a duplex region of at least 19 nucleotides in length, optionally 20 nucleotides in length, wherein the 3' end of the sense strand comprises a stem-loop set forth as S1-L-S2, wherein S1 is complementary to S2, and wherein L forms a loop between S1 and S2 of 3-5 nucleotides in length, wherein the antisense strand comprises a region of complementarity to a NR1H3 mRNA target sequence of any one of SEQ ID NOs: 1-384, and wherein the region of complementarity is 19 contiguous nucleotides in length, optionally 20 nucleotides in length.

Embodiment 16. The RNAi oligonucleotide of any one of embodiments 7 and 13-15, wherein L is a triloop or a tetraloop.

Embodiment 17. The RNAi oligonucleotide of embodiment 16, wherein L is a tetraloop.

Embodiment 18. The RNAi oligonucleotide of embodiment 17, wherein the tetraloop comprises the sequence 5'-GAAA-3'.

Embodiment 19. The RNAi oligonucleotide of any one of embodiments 16-18, wherein the S1 and S2 are 1-10 nucleotides in length and have the same length.

Embodiment 20. The RNAi oligonucleotide of embodiment 19, wherein S1 and S2 are 1 nucleotide, 2 nucleotides, 3 nucleotides, 4 nucleotides, 5 nucleotides, 6 nucleotides, 7 nucleotides, 8 nucleotides, 9 nucleotides, or 10 nucleotides in length.

Embodiment 21. The RNAi oligonucleotide of embodiment 20, wherein S1 and S2 are 6 nucleotides in length.

Embodiment 22. The RNAi oligonucleotide of any one of embodiments 16 to 21, wherein the stem-loop comprises the sequence 5'-GCAGCCGAAAGGCUGC-3' (SEQ ID NO: 1121).

Embodiment 23. The RNAi oligonucleotide of any one of embodiments 1 to 22, wherein the antisense strand comprises a 3'-overhang sequence of one or more nucleotides in length.

Embodiment 24. The RNAi oligonucleotide of embodiment 23, wherein the 3'-overhang sequence is 2 nucleotides in length, optionally wherein the 3'-overhang sequence is GG.

Embodiment 25. The RNAi oligonucleotide of any one of the preceding embodiments, wherein the oligonucleotide comprises at least one modified nucleotide.

Embodiment 26. The RNAi oligonucleotide of embodiment 25, wherein the modified nucleotide comprises a 2'-modification.

Embodiment 27. The RNAi oligonucleotide of embodiment 26, wherein the 2'-modification is a modification selected from 2'-aminoethyl, 2'-fluoro, 2'-O-methyl, 2'-O-methoxyethyl, and 2'-deoxy-2'-fluoro-3-d-arabinonucleic acid.

Embodiment 28. The RNAi oligonucleotide of any one of embodiments 25 to 27, wherein all nucleotides comprising the oligonucleotide are modified, optionally wherein the modification is a 2'-modification selected from 2'-fluoro and 2'-O-methyl.

Embodiment 29. The RNAi oligonucleotide of any one of embodiments 25-28, wherein about 10-15%, 10%, 11%, 12%, 13%, 14%, or 15% of the nucleotides of the sense strand comprise a 2'-fluoro modification.

Embodiment 30. The RNAi oligonucleotide of any one of embodiments 25-29, wherein about 25-35%, 25%, 26%, 27%, 28%, 29%, 30%, 31%, 32%, 33%, 34%, or 35% of the nucleotides of the antisense strand comprise a 2'-fluoro modification.

Embodiment 31. The RNAi oligonucleotide of any one of embodiments 25-30, wherein about 25-35%, 25%, 26%, 27%, 28%, 29%, 30%, 31%, 32%, 33%, 34%, or 35% of the nucleotides of the oligonucleotide comprise a 2'-fluoro modification Embodiment 32. The RNAi oligonucleotide of any one of embodiments 25-31, wherein the sense strand comprises 36 nucleotides with positions 1-36 from 5' to 3', wherein positions 8-11 comprise a 2'-fluoro modification.

Embodiment 33. The RNAi oligonucleotide of any one of embodiments 25-32, wherein the antisense strand comprises 22 nucleotides with positions 1-22 from 5' to 3', and wherein positions 2, 3, 4, 5, 7, 10, and 14 comprise a 2'-fluoro modification.

Embodiment 34. The RNAi oligonucleotide of any one of embodiments 25-33, wherein the remaining nucleotides comprise a 2'-O-methyl modification.

Embodiment 35. The RNAi oligonucleotide of any one of the preceding embodiments, wherein the oligonucleotide comprises at least one modified internucleotide linkage.

Embodiment 36. The RNAi oligonucleotide of embodiment 35, wherein the at least one modified internucleotide linkage is a phosphorothioate linkage.

Embodiment 37. The RNAi oligonucleotide of any one of the preceding embodiments, wherein the 4'-carbon of the sugar of the 5'-nucleotide of the antisense strand comprises a phosphate analog.

Embodiment 38. The RNAi oligonucleotide of embodiment 37, wherein the phosphate analog is oxymethylphosphonate, vinylphosphonate or malonylphosphonate, optionally wherein the phosphate analog is a 4'-phosphate analog comprising 5'-methoxyphosphonate-4'-oxy.

Embodiment 39. The RNAi oligonucleotide of any one of the preceding embodiments, wherein at least one nucleotide of the oligonucleotide is conjugated to one or more targeting ligands.

Embodiment 40. The RNAi oligonucleotide of embodiment 39, wherein each targeting ligand comprises a carbohydrate, amino sugar, cholesterol, polypeptide or lipid.

Embodiment 41. The RNAi oligonucleotide of embodiment 39, wherein each targeting ligand comprises a N-acetylgalactosamine (GalNAc) moiety.

Embodiment 42. The RNAi oligonucleotide of embodiment 35, wherein the GalNAc moiety is a monovalent GalNAc moiety, a bivalent GalNAc moiety, a trivalent GalNAc moiety or a tetravalent GalNAc moiety.

Embodiment 43. The RNAi oligonucleotide of any one of embodiments 16 to 38, wherein up to 4 nucleotides of L of the stem-loop are each conjugated to a monovalent GalNAc moiety.

Embodiment 44. The RNAi oligonucleotide of any one of embodiments 1 to 43, wherein the sense strand comprises a nucleotide sequence of any one of SEQ ID NOs: 769-856 or 1519-1552.

Embodiment 45. The RNAi oligonucleotide of any one of embodiments 1 to 44, wherein the antisense strand comprises a nucleotide sequence of any one of SEQ ID NOs: 857-944.

Embodiment 46. The RNAi oligonucleotide of any one of embodiments 1 to 45, wherein the sense strand and antisense strands comprise nucleotide sequences selected from the group consisting of:
  (a) SEQ ID NOs: 769 and 857, respectively;
  (b) SEQ ID NOs: 770 and 858, respectively;
  (c) SEQ ID NOs: 771 and 859, respectively;
  (d) SEQ ID NOs: 772 and 860, respectively;
  (e) SEQ ID NOs: 773 and 861, respectively;
  (f) SEQ ID NOs: 774 and 862, respectively;
  (g) SEQ ID NOs: 775 and 863, respectively;
  (h) SEQ ID NOs: 776 and 864, respectively;
  (i) SEQ ID NOs: 777 and 865, respectively;
  (j) SEQ ID NOs: 778 and 866, respectively;
  (k) SEQ ID NOs: 779 and 867, respectively;
  (l) SEQ ID NOs: 780 and 868, respectively;
  (m) SEQ ID NOs: 781 and 869, respectively;
  (n) SEQ ID NOs: 782 and 870, respectively;
  (o) SEQ ID NOs: 783 and 871, respectively;
  (p) SEQ ID NOs: 784 and 872, respectively;
  (q) SEQ ID NOs: 785 and 873, respectively;
  (r) SEQ ID NOs: 786 and 874, respectively;
  (s) SEQ ID NOs: 787 and 875, respectively;
  (t) SEQ ID NOs: 788 and 876, respectively;
  (u) SEQ ID NOs: 789 and 877, respectively;
  (v) SEQ ID NOs: 790 and 878, respectively;
  (w) SEQ ID NOs: 791 and 879, respectively;
  (x) SEQ ID NOs: 792 and 880, respectively;
  (y) SEQ ID NOs: 793 and 881, respectively;
  (z) SEQ ID NOs: 794 and 882, respectively;
  (aa) SEQ ID NOs: 795 and 883, respectively;
  (bb) SEQ ID NOs: 796 and 884, respectively;
  (cc) SEQ ID NOs: 797 and 885, respectively;
  (dd) SEQ ID NOs: 798 and 886, respectively;
  (ee) SEQ ID NOs: 799 and 887, respectively;
  (ff) SEQ ID NOs: 800 and 888, respectively;
  (gg) SEQ ID NOs: 801 and 889, respectively;
  (hh) SEQ ID NOs: 802 and 890, respectively;
  (ii) SEQ ID NOs: 803 and 891, respectively;
  (jj) SEQ ID NOs: 804 and 892, respectively;
  (kk) SEQ ID NOs: 805 and 893, respectively;
  (ll) SEQ ID NOs: 806 and 894, respectively;
  (mm) SEQ ID NOs: 807 and 895, respectively;
  (nn) SEQ ID NOs: 808 and 896, respectively;
  (oo) SEQ ID NOs: 809 and 897, respectively;
  (pp) SEQ ID NOs: 810 and 898, respectively;
  (qq) SEQ ID NOs: 811 and 899, respectively;
  (rr) SEQ ID NOs: 812 and 900, respectively;
  (ss) SEQ ID NOs: 813 and 901, respectively;
  (tt) SEQ ID NOs: 814 and 902, respectively;
  (uu) SEQ ID NOs: 815 and 903, respectively;
  (vv) SEQ ID NOs: 816 and 904, respectively;
  (ww) SEQ ID NOs: 817 and 905, respectively;
  (xx) SEQ ID NOs: 818 and 906, respectively;
  (yy) SEQ ID NOs: 819 and 907, respectively;
  (zz) SEQ ID NOs: 820 and 908, respectively;
  (aaa) SEQ ID NOs: 821 and 909, respectively;
  (bbb) SEQ ID NOs: 822 and 910, respectively;
  (ccc) SEQ ID NOs: 823 and 911, respectively;
  (ddd) SEQ ID NOs: 824 and 912, respectively;
  (eee) SEQ ID NOs: 825 and 913, respectively;
  (fff) SEQ ID NOs: 826 and 914, respectively;
  (ggg) SEQ ID NOs: 827 and 915, respectively;
  (hhh) SEQ ID NOs: 828 and 916, respectively;
  (iii) SEQ ID NOs: 829 and 917, respectively;
  (jjj) SEQ ID NOs: 830 and 918, respectively;
  (kkk) SEQ ID NOs: 831 and 919, respectively;
  (lll) SEQ ID NOs: 832 and 920, respectively;
  (mmm) SEQ ID NOs: 833 and 921, respectively;
  (nnn) SEQ ID NOs: 834 and 922, respectively;
  (ooo) SEQ ID NOs: 835 and 923, respectively;
  (ppp) SEQ ID NOs: 836 and 924, respectively;
  (qqq) SEQ ID NOs: 837 and 925, respectively;
  (rrr) SEQ ID NOs: 838 and 926, respectively;
  (sss) SEQ ID NOs: 839 and 927, respectively;
  (ttt) SEQ ID NOs: 840 and 928, respectively;
  (uuu) SEQ ID NOs: 1537 and 929, respectively;
  (vvv) SEQ ID NOs: 842 and 930, respectively;
  (www) SEQ ID NOs: 843 and 931, respectively;
  (xxx) SEQ ID NOs: 844 and 932, respectively;
  (yyy) SEQ ID NOs: 845 and 933, respectively;
  (zzz) SEQ ID NOs: 846 and 934, respectively;
  (aaaa) SEQ ID NOs: 847 and 935, respectively;
  (bbbb) SEQ ID NOs: 848 and 936, respectively;
  (cccc) SEQ ID NOs: 849 and 937, respectively;
  (dddd) SEQ ID NOs: 850 and 938, respectively;
  (eeee) SEQ ID NOs: 851 and 939, respectively;
  (ffff) SEQ ID NOs: 852 and 940, respectively;
  (gggg) SEQ ID NOs: 853 and 941, respectively;
  (hhhh) SEQ ID NOs: 854 and 942, respectively;
  (iiii) SEQ ID NOs: 855 and 943, respectively; and,
  (jjjj) SEQ ID NOs: 856 and 944, respectively.

Embodiment 47. The RNAi oligonucleotide of any one of embodiments 1 to 46, wherein the sense strand comprises a nucleotide sequence as set forth in SEQ ID NO: 786, wherein the antisense strand comprises a nucleotide sequence as set forth in SEQ ID NO: 874.

Embodiment 48. The RNAi oligonucleotide of any one of embodiments 1 to 46, wherein the sense strand comprises a nucleotide sequence as set forth in SEQ ID NO: 787, wherein the antisense strand comprises a nucleotide sequence as set forth in SEQ ID NO: 875.

Embodiment 49. The RNAi oligonucleotide of any one of embodiments 1 to 46, wherein the sense strand comprises a nucleotide sequence as set forth in SEQ ID NO: 1537, wherein the antisense strand comprises a nucleotide sequence as set forth in SEQ ID NO: 929.

Embodiment 50. The RNAi oligonucleotide of any one of embodiments 1 to 46, wherein the sense strand comprises a nucleotide sequence as set forth in SEQ ID NO: 813, wherein the antisense strand comprises a nucleotide sequence as set forth in SEQ ID NO: 901.

Embodiment 51. An RNAi oligonucleotide for reducing NR1H3 expression, the oligonucleotide comprising a sense strand and an antisense strand, wherein the sense strand and the antisense strand form a duplex region, wherein all nucleotides comprising the sense strand and antisense strand are modified, wherein the antisense strand comprises a region of complementarity to a NR1H3 mRNA target sequence of any one of SEQ ID NOs: 1-384, and wherein the region of complementarity is at least 15 contiguous nucleotides in length.

Embodiment 52. An RNAi oligonucleotide for reducing NR1H3 expression, the oligonucleotide comprising a sense strand and an antisense strand, wherein the sense strand and the antisense strand form a duplex region, wherein all nucleotides comprising the sense strand and antisense strand are modified, wherein the 4'-carbon of the sugar of the 5'-nucleotide of the antisense strand comprises a phosphate analog, wherein the antisense strand comprises a region of complementarity to a NR1H3 mRNA target sequence of any one of SEQ ID NOs: 1-384, and wherein the region of complementarity is at least 15 contiguous nucleotides in length.

Embodiment 53. An RNAi oligonucleotide for reducing NR1H3 expression, the oligonucleotide comprising a sense strand and an antisense strand, wherein the sense strand and the antisense strand form a duplex region, wherein all nucleotides comprising the sense strand and antisense strand are modified, wherein the 4'-carbon of the sugar of the 5'-nucleotide of the antisense strand comprises a phosphate analog, wherein the antisense strand comprises a region of complementarity to a NR1H3 mRNA target sequence of any one of SEQ ID NOs: 1-384, and wherein the region of complementarity is at least 15 contiguous nucleotides in length.

Embodiment 54. An RNAi oligonucleotide for reducing NR1H3 expression, the oligonucleotide comprising a sense strand and an antisense strand, wherein the sense strand and the antisense strand form a duplex region, wherein all nucleotides comprising the sense strand and the antisense strand are modified, wherein the antisense strand and the sense strand comprise one or more 2'-fluoro and 2'-O-methyl modified nucleotides and at least one phosphorothioate linkage, wherein the 4'-carbon of the sugar of the 5'-nucleotide of the antisense strand comprises a phosphate analog, wherein the antisense strand comprises a region of complementarity to a NR1H3 mRNA target sequence of any one of SEQ ID NOs: 1-384, and wherein the region of complementarity is at least 15 contiguous nucleotides in length.

Embodiment 55. The RNAi oligonucleotide of any one of embodiments 1-54, wherein the sense strand comprises a nucleotide sequence of any one of SEQ ID NOs: 945-1032.

Embodiment 56. The RNAi oligonucleotide of any one of embodiments 1-55, wherein the antisense strand comprises a nucleotide sequence of any one of SEQ ID NOs: 1033-1120.

Embodiment 57. The RNAi oligonucleotide of any one of embodiments 1-56, wherein the sense and antisense strands comprise nucleotide sequences selected from the group consisting of:
(a) SEQ ID NOs: 945 and 1033, respectively;
(b) SEQ ID NOs: 946 and 1034, respectively;
(c) SEQ ID NOs: 947 and 1035, respectively;
(d) SEQ ID NOs: 948 and 1036, respectively;
(e) SEQ ID NOs: 949 and 1037, respectively;
(f) SEQ ID NOs: 950 and 1038, respectively;
(g) SEQ ID NOs: 951 and 1039, respectively;
(h) SEQ ID NOs: 952 and 1040, respectively;
(i) SEQ ID NOs: 953 and 1041, respectively;
(j) SEQ ID NOs: 954 and 1042, respectively;
(k) SEQ ID NOs: 955 and 1043, respectively;
(l) SEQ ID NOs: 956 and 1044 respectively;
(m) SEQ ID NOs: 957 and 1045, respectively;
(n) SEQ ID NOs: 958 and 1046, respectively;
(o) SEQ ID NOs: 959 and 1047, respectively;
(p) SEQ ID NOs: 960 and 1048, respectively;
(q) SEQ ID NOs: 961 and 1049, respectively;
(r) SEQ ID NOs: 962 and 1050, respectively;
(s) SEQ ID NOs: 963 and 1051, respectively;
(t) SEQ ID NOs: 964 and 1052, respectively;
(u) SEQ ID NOs: 965 and 1053, respectively;
(v) SEQ ID NOs: 966 and 1054, respectively;
(w) SEQ ID NOs: 967 and 1055, respectively;
(x) SEQ ID NOs: 968 and 1056, respectively;
(y) SEQ ID NOs: 969 and 1057, respectively;
(z) SEQ ID NOs: 970 and 1058, respectively;
(aa) SEQ ID NOs: 971 and 1059, respectively;
(bb) SEQ ID NOs: 972 and 1060, respectively;
(cc) SEQ ID NOs: 973 and 1061, respectively;
(dd) SEQ ID NOs: 974 and 1062, respectively;
(ee) SEQ ID NOs: 975 and 1063, respectively;
(ff) SEQ ID NOs: 976 and 1064, respectively;
(gg) SEQ ID NOs: 977 and 1065, respectively;
(hh) SEQ ID NOs: 978 and 1066, respectively;
(ii) SEQ ID NOs: 979 and 1067, respectively;
(jj) SEQ ID NOs: 980 and 1068, respectively;
(kk) SEQ ID NOs: 981 and 1069, respectively;
(ll) SEQ ID NOs: 982 and 1070, respectively;
(mm) SEQ ID NOs: 983 and 1071, respectively;
(nn) SEQ ID NOs: 984 and 1072, respectively;
(oo) SEQ ID NOs: 985 and 1073, respectively;
(pp) SEQ ID NOs: 986 and 1074, respectively;
(qq) SEQ ID NOs: 987 and 1075, respectively;
(rr) SEQ ID NOs: 988 and 1076, respectively;
(ss) SEQ ID NOs: 989 and 1077, respectively;
(tt) SEQ ID NOs: 990 and 1078, respectively;
(uu) SEQ ID NOs: 991 and 1079, respectively;
(vv) SEQ ID NOs: 992 and 1080, respectively;
(ww) SEQ ID NOs: 993 and 1081, respectively;
(xx) SEQ ID NOs: 994 and 1082, respectively;
(yy) SEQ ID NOs: 995 and 1083, respectively;
(zz) SEQ ID NOs: 996 and 1084, respectively;
(aaa) SEQ ID NOs: 997 and 1085, respectively;
(bbb) SEQ ID NOs: 998 and 1086, respectively;
(ccc) SEQ ID NOs: 999 and 1087, respectively;
(ddd) SEQ ID NOs: 1000 and 1088, respectively;
(eee) SEQ ID NOs: 1001 and 1089, respectively;
(fff) SEQ ID NOs: 1002 and 1090, respectively;
(ggg) SEQ ID NOs: 1003 and 1091, respectively;
(hhh) SEQ ID NOs: 1004 and 1092 respectively;
(iii) SEQ ID NOs: 1005 and 1093 respectively;
(jjj) SEQ ID NOs: 1006 and 1094, respectively;
(kkk) SEQ ID NOs: 1007 and 1095, respectively;
(lll) SEQ ID NOs: 1008 and 1096, respectively;
(mmm) SEQ ID NOs: 1009 and 1097, respectively;
(nnn) SEQ ID NOs: 1010 and 1098, respectively;
(ooo) SEQ ID NOs: 1011 and 1099, respectively;
(ppp) SEQ ID NOs: 1012 and 1100, respectively;
(qqq) SEQ ID NOs: 1013 and 1101, respectively;
(rrr) SEQ ID NOs: 1014 and 1102 respectively;
(sss) SEQ ID NOs: 1015 and 1103, respectively;
(ttt) SEQ ID NOs: 1016 and 1104, respectively;
(uuu) SEQ ID NOs: 1017 and 1105, respectively;
(vvv) SEQ ID NOs: 1018 and 1106, respectively;
(www) SEQ ID NOs: 1019 and 1107, respectively;

(xxx) SEQ ID NOs: 1020 and 1108, respectively;
(yyy) SEQ ID NOs: 1021 and 1109, respectively;
(zzz) SEQ ID NOs: 1022 and 1110, respectively;
(aaaa) SEQ ID NOs: 1023 and 1111, respectively;
(bbbb) SEQ ID NOs: 1024 and 1112, respectively;
(cccc) SEQ ID NOs: 1025 and 1113, respectively;
(dddd) SEQ ID NOs: 1026 and 1114, respectively;
(eeee) SEQ ID NOs: 1027 and 1115, respectively;
(ffff) SEQ ID NOs: 1028 and 1116, respectively;
(gggg) SEQ ID NOs: 1029 and 1117, respectively;
(hhhh) SEQ ID NOs: 1030 and 1118, respectively;
(iiii) SEQ ID NOs: 1031 and 1119, respectively; and,
(jjjj) SEQ ID NOs: 1032 and 1120, respectively.
Embodiment 58. The RNAi oligonucleotide of any one of embodiments 1-57, wherein the sense and antisense strands comprise the nucleotide sequences set forth in SEQ ID NOs: 963 and 1051, respectively.
Embodiment 59. The RNAi oligonucleotide of any one of embodiments 1-57, wherein the sense and antisense strands comprise the nucleotide sequences set forth in SEQ ID NOs: 964 and 1052, respectively.
Embodiment 60. The RNAi oligonucleotide of any one of embodiments 1-57, wherein the sense and antisense strands comprise the nucleotide sequences set forth in SEQ ID NOs: 1006 and 1094, respectively.

Embodiment 61. The RNAi oligonucleotide of any one of embodiments 1-57, wherein the sense and antisense strands comprise the nucleotide sequences set forth in SEQ ID NOs: 1018 and 1106, respectively.

Embodiment 62. An RNAi oligonucleotide for inhibiting expression of NR1H3, wherein said dsRNA comprises a sense strand and an antisense strand, the antisense strand comprising a region of complementarity to a NR1H3 RNA transcript, wherein the sense strand comprises the sequence and all of the modifications of 5'-mCs-mU-mC-mA-mA-mG-mG-fA-fU-fU-fU-mC-mA-mG-mU-mU-mA-mU-mA-mA-mG-mC-mA-mG-mC-mC-mG-[ademA-GalNAc]-[ademA-GalNAc]-[ademA-GalNAc]-mG-mG-mC-mU-mG-mC-3' (SEQ ID NO: 963), and wherein the antisense strand comprises the sequence and all of the modifications of 5'-[MePhosphonate-40-mUs]-fUs-fAs-fU-fA-mA-fC-mU-mG-fA-mA-mA-mU-fC-mC-mU-mU-mG-mA-mGs-mGs-mG-3' (SEQ ID NO: 1051), wherein mC, mA, mG, and mU=2'-OMe ribonucleosides; fA, fC, fG, and fU=2'-F ribonucleosides; s=phosphorothioate, and wherein ademA-GalNAc=

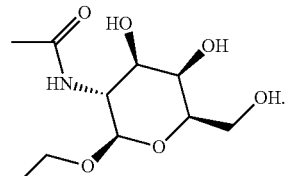

Embodiment 63. An RNAi oligonucleotide for inhibiting expression of NR1H3, wherein said dsRNA comprises a sense strand and an antisense strand, the antisense strand comprising a region of complementarity to a NR1H3 RNA transcript, wherein the sense strand comprises the sequence and all of the modifications of 5'-mUs-mC-mA-mA-mG-mG-mA-fU-fU-fU-fC-mA-mG-mU-mU-mA-mU-mA-mA-mG-mC-mA-mG-mC-mC-mG-[ademA-GalNAc]-[ademA-GalNAc]-[ademA-GalNAc]-mG-mG-mC-mU-mG-mC-3' (SEQ ID NO: 964) and wherein the antisense strand comprises the sequence and all of the modifications of 5'-[MePhosphonate-40-mUs]-fUs-fUs-fA-fU-mA-fA-mC-mU-fG-mA-mA-mA-fU-mC-mC-mU-mU-mG-mAs-mGs-mG-3' (SEQ ID NO: 1052), wherein mC, mA, mG, and mU=2'-OMe ribonucleosides; fA, fC, fG, and fU=2'-F ribonucleosides; s=phosphorothioate, and wherein ademA-GalNAc=

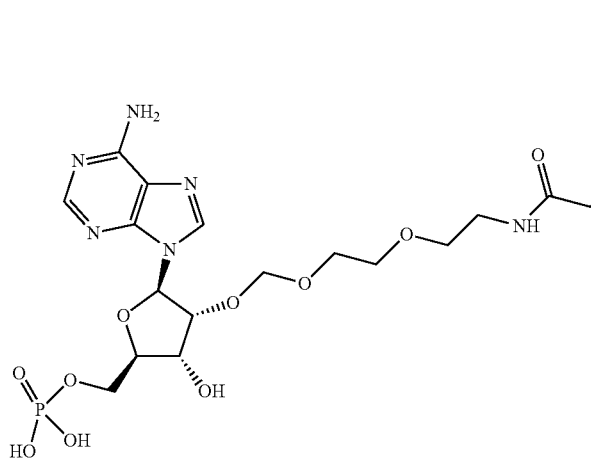

Embodiment 64. An RNAi oligonucleotide for inhibiting expression of NR1H3, wherein said dsRNA comprises a sense strand and an antisense strand, the antisense strand comprising a region of complementarity to a NR1H3 RNA transcript, wherein the sense strand comprises the sequence and all of the modifications of 5'-mAs-mG-mC-mA-mG-mC-mG-fU-fC-fC-fA-mC-mU-mC-mA-mG-mA-mG-mC-mA-mG-mC-mA-mG-mC-mC-mG-[ademA-GalNAc]-[ademA-GalNAc]-[ademA-GalNAc]-mG-mG-mC-mU-mG-mC-3' (SEQ ID NO: 1006), and wherein the antisense strand comprises the sequence and all of the modifications of 5'[MePhosphonate-40-mUs]-fGs-fCs-fU-fC-mU-fG-mA-mG-fU-mG-mG-mA-fC-mG-mC-mU-mG-mC-mUs-mGs-mG-3' (SEQ ID NO: 1094), wherein mC, mA, mG, and mU=2'-OMe ribonucleosides; fA, fC, fG, and fU=2'-F ribonucleosides; s=phosphorothioate, and wherein ademA-GalNAc=

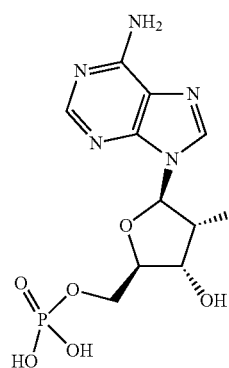

Embodiment 65. A double stranded RNAi oligonucleotide (dsRNAi) for inhibiting expression of NR1H3, wherein said dsRNA comprises a sense strand and an antisense strand, the antisense strand comprising a region of complementarity to a NR1H3 RNA transcript, wherein the sense strand comprises the sequence and all of the modifications of 5'-mAs-mU-mG-mU-mG-mC-mA-fC-fG-fA-fA-mU-mG-mA-mC-mU-mG-mU-mU-mA-mG-mC-mA-mG-mC-mC-mG-[ademA-GalNAc]-[ademA-GalNAc]-[ademA-GalNAc]-mG-mG-mC-mU-mG-mC-3' (SEQ ID NO: 1018), and wherein the antisense strand comprises the sequence and all of the modifications of 5'-[MePhosphonate-40-mUs]-fAs-fAs-fC-fA-mG-fU-mC-mA-fU-mU-mC-mG-fU-mG-mC-mA-mC-mA-mUs-mGs-mG-3' (SEQ ID NO: 1106), wherein mC, mA, mG, and mU=2'-OMe ribonucleosides; fA, fC, fG, and fU=2'-F ribonucleosides; s=phosphorothioate, and wherein ademA-GalNAc=

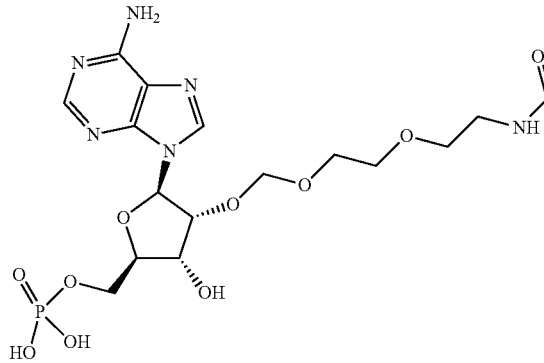
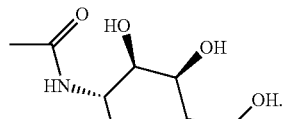

Embodiment 66. A method for treating a subject having a disease, disorder or condition associated with NR1H3 expression, the method comprising administering to the subject a therapeutically effective amount of the RNAi oligonucleotide of any one of the preceding embodiments, or pharmaceutical composition thereof, thereby treating the subject.

Embodiment 67. A pharmaceutical composition comprising the RNAi oligonucleotide of any one of embodiments 1 to 65, and a pharmaceutically acceptable carrier, delivery agent or excipient.

Embodiment 68. A method of delivering an oligonucleotide to a subject, the method comprising administering pharmaceutical composition of embodiment 67 to the subject.

Embodiment 69. A method for reducing NR1H3 expression in a cell, a population of cells or a subject, the method comprising the step of:
  i. contacting the cell or the population of cells with the RNAi oligonucleotide of any one of embodiments 1 to 65, or the pharmaceutical composition of embodiment 67; or
  ii. administering to the subject the RNAi oligonucleotide of any one of embodiments 1 to 65, or the pharmaceutical composition of embodiment 67.

Embodiment 70. The method of embodiment 69, wherein reducing NR1H3 expression comprises reducing an amount or level of NR1H3 mRNA, an amount or level of NR1H3 protein, or both.

Embodiment 71. The method of embodiment 69 or 70, wherein the subject has a disease, disorder or condition associated with NR1H3 expression.

Embodiment 72. The method of embodiment 66 or 71, wherein the disease, disorder or condition associated with NR1H3 expression is non-alcoholic fatty liver disease (NAFLD), non-alcoholic steatohepatitis (NASH), multiple sclerosis, or systemic lupus erythematosus.

Embodiment 73. The method of any one of embodiments 66 and 69 to 72, wherein the RNAi oligonucleotide, or pharmaceutical composition, is administered in combination with a second composition or therapeutic agent.

Embodiment 74. A method for treating a subject having a disease, disorder or condition associated with NR1H3 expression, the method comprising administering to the subject a therapeutically effective amount of an RNAi oligonucleotide comprising a sense strand and an antisense strand, wherein the sense strand and the antisense strand form a duplex region, wherein the antisense strand comprises a region of complementarity to a NR1H3 mRNA target sequence of any one of SEQ ID NOs: 1-384, and wherein the region of complementarity is at least 15 contiguous nucleotides in length.

Embodiment 75. A method for treating a subject having a disease, disorder or condition associated with NR1H3 expression, the method comprising administering to the subject a therapeutically effective amount of an RNAi oligonucleotide comprising a sense strand and an antisense strand selected from a row set forth in Table 4 or Table 5, or pharmaceutical composition thereof, thereby treating the subject.

Embodiment 76. A method for treating a subject having a disease, disorder or condition associated with NR1H3 expression, the method comprising administering to the subject a therapeutically effective amount of an RNAi oligonucleotide comprising a sense strand and an antisense strand, wherein the sense strand and antisense strands comprise nucleotide sequences selected from the group consisting of:
(a) SEQ ID NOs: 769 and 857, respectively;
(b) SEQ ID NOs: 770 and 858, respectively;
(c) SEQ ID NOs: 771 and 859, respectively;
(d) SEQ ID NOs: 772 and 860, respectively;
(e) SEQ ID NOs: 773 and 861, respectively;
(f) SEQ ID NOs: 774 and 862, respectively;
(g) SEQ ID NOs: 775 and 863, respectively;
(h) SEQ ID NOs: 776 and 864, respectively;
(i) SEQ ID NOs: 777 and 865, respectively;
(j) SEQ ID NOs: 778 and 866, respectively;
(k) SEQ ID NOs: 779 and 867, respectively;
(l) SEQ ID NOs: 780 and 868, respectively;
(m) SEQ ID NOs: 781 and 869, respectively;
(n) SEQ ID NOs: 782 and 870, respectively;
(o) SEQ ID NOs: 783 and 871, respectively;
(p) SEQ ID NOs: 784 and 872, respectively;
(q) SEQ ID NOs: 785 and 873, respectively;
(r) SEQ ID NOs: 786 and 874, respectively;
(s) SEQ ID NOs: 787 and 875, respectively;
(t) SEQ ID NOs: 788 and 876, respectively;
(u) SEQ ID NOs: 789 and 877, respectively;
(v) SEQ ID NOs: 790 and 878, respectively;
(w) SEQ ID NOs: 791 and 879, respectively;
(x) SEQ ID NOs: 792 and 880, respectively;
(y) SEQ ID NOs: 793 and 881, respectively;
(z) SEQ ID NOs: 794 and 882, respectively;

(aa) SEQ ID NOs: 795 and 883, respectively;
(bb) SEQ ID NOs: 796 and 884, respectively;
(cc) SEQ ID NOs: 797 and 885, respectively;
(dd) SEQ ID NOs: 798 and 886, respectively;
(ee) SEQ ID NOs: 799 and 887, respectively;
(ff) SEQ ID NOs: 800 and 888, respectively;
(gg) SEQ ID NOs: 801 and 889, respectively;
(hh) SEQ ID NOs: 802 and 890, respectively;
(ii) SEQ ID NOs: 803 and 891, respectively;
(jj) SEQ ID NOs: 804 and 892, respectively;
(kk) SEQ ID NOs: 805 and 893, respectively;
(ll) SEQ ID NOs: 806 and 894, respectively;
(mm) SEQ ID NOs: 807 and 895, respectively;
(nn) SEQ ID NOs: 808 and 896, respectively;
(oo) SEQ ID NOs: 809 and 897, respectively;
(pp) SEQ ID NOs: 810 and 898, respectively;
(qq) SEQ ID NOs: 811 and 899, respectively;
(rr) SEQ ID NOs: 812 and 900, respectively;
(ss) SEQ ID NOs: 813 and 901, respectively;
(tt) SEQ ID NOs: 814 and 902, respectively;
(uu) SEQ ID NOs: 815 and 903, respectively;
(vv) SEQ ID NOs: 816 and 904, respectively;
(ww) SEQ ID NOs: 817 and 905, respectively;
(xx) SEQ ID NOs: 818 and 906, respectively;
(yy) SEQ ID NOs: 819 and 907, respectively;
(zz) SEQ ID NOs: 820 and 908, respectively;
(aaa) SEQ ID NOs: 821 and 909, respectively;
(bbb) SEQ ID NOs: 822 and 910, respectively;
(ccc) SEQ ID NOs: 823 and 911, respectively;
(ddd) SEQ ID NOs: 824 and 912, respectively;
(eee) SEQ ID NOs: 825 and 913, respectively;
(fff) SEQ ID NOs: 826 and 914, respectively;
(ggg) SEQ ID NOs: 827 and 915, respectively;
(hhh) SEQ ID NOs: 828 and 916, respectively;
(iii) SEQ ID NOs: 829 and 917, respectively;
(jjj) SEQ ID NOs: 830 and 918, respectively;
(kkk) SEQ ID NOs: 831 and 919, respectively;
(lll) SEQ ID NOs: 832 and 920, respectively;
(mmm) SEQ ID NOs: 833 and 921, respectively;
(nnn) SEQ ID NOs: 834 and 922, respectively;
(ooo) SEQ ID NOs: 835 and 923, respectively;
(ppp) SEQ ID NOs: 836 and 924, respectively;
(qqq) SEQ ID NOs: 837 and 925, respectively;
(rrr) SEQ ID NOs: 838 and 926, respectively;
(sss) SEQ ID NOs: 839 and 927, respectively;
(ttt) SEQ ID NOs: 840 and 928, respectively;
(uuu) SEQ ID NOs: 1537 and 929, respectively;
(vvv) SEQ ID NOs: 842 and 930, respectively;
(www) SEQ ID NOs: 843 and 931, respectively;
(xxx) SEQ ID NOs: 844 and 932, respectively;
(yyy) SEQ ID NOs: 845 and 933, respectively;
(zzz) SEQ ID NOs: 846 and 934, respectively;
(aaaa) SEQ ID NOs: 847 and 935, respectively;
(bbbb) SEQ ID NOs: 848 and 936, respectively;
(cccc) SEQ ID NOs: 849 and 937, respectively;
(dddd) SEQ ID NOs: 850 and 938, respectively;
(eeee) SEQ ID NOs: 851 and 939, respectively;
(ffff) SEQ ID NOs: 852 and 940, respectively;
(gggg) SEQ ID NOs: 853 and 941, respectively;
(hhhh) SEQ ID NOs: 854 and 942, respectively;
(iiii) SEQ ID NOs: 855 and 943, respectively; and,
(jjjj) SEQ ID NOs: 856 and 944, respectively.
Embodiment 77. The method of embodiment 76, wherein the sense strand comprises a nucleotide sequence as set forth in SEQ ID NO: 786, wherein the antisense strand comprises a nucleotide sequence as set forth in SEQ ID NO: 874.
Embodiment 78. The method of embodiment 76, wherein the sense strand comprises a nucleotide sequence as set forth in SEQ ID NO: 787, wherein the antisense strand comprises a nucleotide sequence as set forth in SEQ ID NO: 875.
Embodiment 79. The method of embodiment 76, wherein the sense strand comprises a nucleotide sequence as set forth in SEQ ID NO: 1537, wherein the antisense strand comprises a nucleotide sequence as set forth in SEQ ID NO: 929.
Embodiment 80. The method of embodiment 76, wherein the sense strand comprises a nucleotide sequence as set forth in SEQ ID NO: 813, wherein the antisense strand comprises a nucleotide sequence as set forth in SEQ ID NO: 901.
Embodiment 81. A method for treating a subject having a disease, disorder or condition associated with NR1H3 expression, the method comprising administering to the subject a therapeutically effective amount of an RNAi oligonucleotide comprising a sense strand and an antisense strand, wherein the sense strand and antisense strands comprise nucleotide sequences selected from the group consisting of:
(a) SEQ ID NOs: 945 and 1033, respectively;
(b) SEQ ID NOs: 946 and 1034, respectively;
(c) SEQ ID NOs: 947 and 1035, respectively;
(d) SEQ ID NOs: 948 and 1036, respectively;
(e) SEQ ID NOs: 949 and 1037, respectively;
(f) SEQ ID NOs: 950 and 1038, respectively;
(g) SEQ ID NOs: 951 and 1039, respectively;
(h) SEQ ID NOs: 952 and 1040, respectively;
(i) SEQ ID NOs: 953 and 1041, respectively;
(j) SEQ ID NOs: 954 and 1042, respectively;
(k) SEQ ID NOs: 955 and 1043, respectively;
(l) SEQ ID NOs: 956 and 1044 respectively;
(m) SEQ ID NOs: 957 and 1045, respectively;
(n) SEQ ID NOs: 958 and 1046, respectively;
(o) SEQ ID NOs: 959 and 1047, respectively;
(p) SEQ ID NOs: 960 and 1048, respectively;
(q) SEQ ID NOs: 961 and 1049, respectively;
(r) SEQ ID NOs: 962 and 1050, respectively;
(s) SEQ ID NOs: 963 and 1051, respectively;
(t) SEQ ID NOs: 964 and 1052, respectively;
(u) SEQ ID NOs: 965 and 1053, respectively;
(v) SEQ ID NOs: 966 and 1054, respectively;
(w) SEQ ID NOs: 967 and 1055, respectively;
(x) SEQ ID NOs: 968 and 1056, respectively;
(y) SEQ ID NOs: 969 and 1057, respectively;
(z) SEQ ID NOs: 970 and 1058, respectively;
(aa) SEQ ID NOs: 971 and 1059, respectively;
(bb) SEQ ID NOs: 972 and 1060, respectively;
(cc) SEQ ID NOs: 973 and 1061, respectively;
(dd) SEQ ID NOs: 974 and 1062, respectively;
(ee) SEQ ID NOs: 975 and 1063, respectively;
(ff) SEQ ID NOs: 976 and 1064, respectively;
(gg) SEQ ID NOs: 977 and 1065, respectively;
(hh) SEQ ID NOs: 978 and 1066, respectively;
(ii) SEQ ID NOs: 979 and 1067, respectively;
(jj) SEQ ID NOs: 980 and 1068, respectively;
(kk) SEQ ID NOs: 981 and 1069, respectively;
(ll) SEQ ID NOs: 982 and 1070, respectively;
(mm) SEQ ID NOs: 983 and 1071, respectively;
(nn) SEQ ID NOs: 984 and 1072, respectively;
(oo) SEQ ID NOs: 985 and 1073, respectively;
(pp) SEQ ID NOs: 986 and 1074, respectively;
(qq) SEQ ID NOs: 987 and 1075, respectively;
(rr) SEQ ID NOs: 988 and 1076, respectively;
(ss) SEQ ID NOs: 989 and 1077, respectively;
(tt) SEQ ID NOs: 990 and 1078, respectively;
(uu) SEQ ID NOs: 991 and 1079, respectively;

(vv) SEQ ID NOs: 992 and 1080, respectively;
(ww) SEQ ID NOs: 993 and 1081, respectively;
(xx) SEQ ID NOs: 994 and 1082, respectively;
(yy) SEQ ID NOs: 995 and 1083, respectively;
(zz) SEQ ID NOs: 996 and 1084, respectively;
(aaa) SEQ ID NOs: 997 and 1085, respectively;
(bbb) SEQ ID NOs: 998 and 1086, respectively;
(ccc) SEQ ID NOs: 999 and 1087, respectively;
(ddd) SEQ ID NOs: 1000 and 1088, respectively;
(eee) SEQ ID NOs: 1001 and 1089, respectively;
(fff) SEQ ID NOs: 1002 and 1090, respectively;
(ggg) SEQ ID NOs: 1003 and 1091, respectively;
(hhh) SEQ ID NOs: 1004 and 1092 respectively;
(iii) SEQ ID NOs: 1005 and 1093 respectively;
(jjj) SEQ ID NOs: 1006 and 1094, respectively;
(kkk) SEQ ID NOs: 1007 and 1095, respectively;
(lll) SEQ ID NOs: 1008 and 1096, respectively;
(mmm) SEQ ID NOs: 1009 and 1097, respectively;
(nnn) SEQ ID NOs: 1010 and 1098, respectively;
(ooo) SEQ ID NOs: 1011 and 1099, respectively;
(ppp) SEQ ID NOs: 1012 and 1100, respectively;
(qqq) SEQ ID NOs: 1013 and 1101, respectively;
(rrr) SEQ ID NOs: 1014 and 1102 respectively;
(sss) SEQ ID NOs: 1015 and 1103, respectively;
(ttt) SEQ ID NOs: 1016 and 1104, respectively;
(uuu) SEQ ID NOs: 1017 and 1105, respectively;
(vvv) SEQ ID NOs: 1018 and 1106, respectively;
(www) SEQ ID NOs: 1019 and 1107, respectively;
(xxx) SEQ ID NOs: 1020 and 1108, respectively;
(yyy) SEQ ID NOs: 1021 and 1109, respectively;
(zzz) SEQ ID NOs: 1022 and 1110, respectively;
(aaaa) SEQ ID NOs: 1023 and 1111, respectively;
(bbbb) SEQ ID NOs: 1024 and 1112, respectively;
(cccc) SEQ ID NOs: 1025 and 1113, respectively;
(dddd) SEQ ID NOs: 1026 and 1114, respectively;
(eeee) SEQ ID NOs: 1027 and 1115, respectively;
(ffff) SEQ ID NOs: 1028 and 1116, respectively;
(gggg) SEQ ID NOs: 1029 and 1117, respectively;
(hhhh) SEQ ID NOs: 1030 and 1118, respectively;
(iiii) SEQ ID NOs: 1031 and 1119, respectively, and;
(jjjj) SEQ ID NOs: 1032 and 1120, respectively.

Embodiment 82. The method of embodiment 81, wherein the sense strand comprises a nucleotide sequence as set forth in SEQ ID NO: 963, wherein the antisense strand comprises a nucleotide sequence as set forth in SEQ ID NO: 1051.

Embodiment 83. The method of embodiment 81, wherein the sense strand comprises a nucleotide sequence as set forth in SEQ ID NO: 964, wherein the antisense strand comprises a nucleotide sequence as set forth in SEQ ID NO: 1052.

Embodiment 84. The method of embodiment 81, wherein the sense strand comprises a nucleotide sequence as set forth in SEQ ID NO: 1006, wherein the antisense strand comprises a nucleotide sequence as set forth in SEQ ID NO: 1094.

Embodiment 85. The method of embodiment 81, wherein the sense strand comprises a nucleotide sequence as set forth in SEQ ID NO: 1018, wherein the antisense strand comprises a nucleotide sequence as set forth in SEQ ID NO: 1106.

Embodiment 86. The method of any one of embodiments 74 to 85, wherein the disease, disorder or condition associated with NR1H3 expression is non-alcoholic fatty liver disease (NAFLD), non-alcoholic steatohepatitis (NASH), multiple sclerosis, or systemic lupus erythematosus.

Embodiment 87. Use of the RNAi oligonucleotide of any one of embodiments 1 to 65, or the pharmaceutical composition of embodiment 67, in the manufacture of a medicament for the treatment of a disease, disorder or condition associated with NR1H3 expression, optionally for the treatment of non-alcoholic fatty liver disease (NAFLD), non-alcoholic steatohepatitis (NASH), multiple sclerosis, or systemic lupus erythematosus.

Embodiment 88. The RNAi oligonucleotide of any one of embodiments 1 to 65, or the pharmaceutical composition of embodiment 67, for use, or adaptable for use, in the treatment of a disease, disorder or condition associated with NR1H3 expression, optionally for the treatment of non-alcoholic fatty liver disease (NAFLD), non-alcoholic steatohepatitis (NASH), multiple sclerosis, or systemic lupus erythematosus.

Embodiment 89. A kit comprising the RNAi oligonucleotide of any one of embodiments 1 to 65, an optional pharmaceutically acceptable carrier, and a package insert comprising instructions for administration to a subject having a disease, disorder or condition associated with NR1H3 expression.

Embodiment 90. The use of embodiment 87, the RNAi oligonucleotide or pharmaceutical composition for use, or adaptable for use, of embodiment 88, or the kit of embodiment 89, wherein the disease, disorder or condition associated with NR1H3 expression is non-alcoholic fatty liver disease (NAFLD), non-alcoholic steatohepatitis (NASH), multiple sclerosis, or systemic lupus erythematosus.

Embodiment 91. A double stranded RNAi oligonucleotide (dsRNAi) for reducing NR1H3 expression, the oligonucleotide comprising a sense strand and an antisense strand, wherein the sense strand and the antisense strand form a duplex region, wherein (i) the sense strand comprises a nucleotide sequence comprising at least 15, 17, or 19 contiguous nucleotides, with 0, 1, 2, or 3 mismatches, of a portion of a nucleotide sequence of any one of SEQ ID NOs: 1-384, SEQ ID NOs: 1125-1511, SEQ ID NOs: 769-856, SEQ ID NOs: 1519-1552 or SEQ ID NOs: 945-1032; and (ii) the antisense strand comprises a nucleotide sequence comprising at least 15, 17, or 19 contiguous nucleotides, with 0, 1, 2, or 3 mismatches, of a portion of a nucleotide sequence of any one of SEQ ID NOs: 385-768, SEQ ID NOs 857-944, SEQ ID NOs 1512-1515, or SEQ ID NOs: 1033-1120.

SEQUENCE LISTING (1552 sequences)

SEQ ID NO: 1 - RNA, 25 nt, Artificial Sequence
  Synthetic
uguccugucagaagaacagauccgc

SEQ ID NO: 2 - RNA, 25 nt, Artificial Sequence
  Synthetic
uccugucagaagaacagauacgccu

SEQ ID NO: 3 - RNA, 25 nt, Artificial Sequence
  Synthetic
cugaagaaacugaagcggcaagagg

SEQ ID NO: 4 - RNA, 25 nt, Artificial Sequence
  Synthetic
ugaagaaacugaagcggcaagagga

SEQ ID NO: 5 - RNA, 25 nt, Artificial Sequence
  Synthetic
gaagaaacugaagcggcaaaaggag

SEQ ID NO: 6 - RNA, 25 nt, Artificial Sequence
  Synthetic
aagaaacugaagcggcaagaggagg

SEQ ID NO: 7 - RNA, 25 nt, Artificial Sequence
  Synthetic
agaaacugaagcggcaagaagagga

SEQ ID NO: 8 - RNA, 25 nt, Artificial Sequence
  Synthetic
aaacugaagcggcaagaggaggaac

SEQ ID NO: 9 - RNA, 25 nt, Artificial Sequence
  Synthetic
aacugaagcggcaagaggaagaaca

SEQ ID NO: 10 - RNA, 25 nt, Artificial Sequence
  Synthetic
acugaagcggcaagaggagaaacag

SEQ ID NO: 11 - RNA, 25 nt, Artificial Sequence
  Synthetic
cugaagcggcaagaggaggaacagg

SEQ ID NO: 12 - RNA, 25 nt, Artificial Sequence
  Synthetic
ugaagcggcaagaggaggaacaggc

SEQ ID NO: 13 - RNA, 25 nt, Artificial Sequence
  Synthetic
agcggcaagaggaggaacaagcuca

SEQ ID NO: 14 - RNA, 25 nt, Artificial Sequence
  Synthetic
gcggcaagaggaggaacagacucau

SEQ ID NO: 15 - RNA, 25 nt, Artificial Sequence
  Synthetic
cggcaagaggaggaacaggaucaug

SEQ ID NO: 16 - RNA, 25 nt, Artificial Sequence
  Synthetic
gcaagaggaggaacaggcuaaugcc

SEQ ID NO: 17 - RNA, 25 nt, Artificial Sequence
  Synthetic
aagaggaggaacaggcucaagccac

SEQ ID NO: 18 - RNA, 25 nt, Artificial Sequence
  Synthetic
agaggaggaacaggcucauaccaca

SEQ ID NO: 19 - RNA, 25 nt, Artificial Sequence
  Synthetic
gaggaggaacaggcucaugacacau

SEQ ID NO: 20 - RNA, 25 nt, Artificial Sequence
  Synthetic
aggaggaacaggcucaugcaacauc

SEQ ID NO: 21 - RNA, 25 nt, Artificial Sequence
  Synthetic
gaggaacaggcucaugccaaauccu

SEQ ID NO: 22 - RNA, 25 nt, Artificial Sequence
  Synthetic
ccagggcuuccucacccccacaaau

SEQ ID NO: 23 - RNA, 25 nt, Artificial Sequence
  Synthetic
ugggcaugaucgagaagcuagucgc

SEQ ID NO: 24 - RNA, 25 nt, Artificial Sequence
  Synthetic
gcaugaucgagaagcucguagcugc

SEQ ID NO: 25 - RNA, 25 nt, Artificial Sequence
  Synthetic
gucgcugcccagcaacaguauaacc

SEQ ID NO: 26 - RNA, 25 nt, Artificial Sequence
  Synthetic
cgcugcccagcaacaguguaaccgg

SEQ ID NO: 27 - RNA, 25 nt, Artificial Sequence
  Synthetic
cccagcaacaguguaaccgacgcuc

SEQ ID NO: 28 - RNA, 25 nt, Artificial Sequence
  Synthetic
cagcaacaguguaaccggcacuccu

SEQ ID NO: 29 - RNA, 25 nt, Artificial Sequence
  Synthetic
agcaacaguguaaccggcgauccuu

SEQ ID NO: 30 - RNA, 25 nt, Artificial Sequence
  Synthetic
caacaguguaaccggcgcuacuuuu

SEQ ID NO: 31 - RNA, 25 nt, Artificial Sequence
  Synthetic
aacaguguaaccggcgcucauuuuc

SEQ ID NO: 32 - RNA, 25 nt, Artificial Sequence
  Synthetic
acaguguaaccggcgcuccauuucu

SEQ ID NO: 33 - RNA, 25 nt, Artificial Sequence
  Synthetic
caguguaaccggcgcuccuauucug

SEQ ID NO: 34 - RNA, 25 nt, Artificial Sequence
  Synthetic
aguguaaccggcgcuccuuaucuga

SEQ ID NO: 35 - RNA, 25 nt, Artificial Sequence
  Synthetic
guguaaccggcgcuccuuuacugac

SEQ ID NO: 36 - RNA, 25 nt, Artificial Sequence
  Synthetic
uguaaccggcgcuccuuuuaugacc

SEQ ID NO: 37 - RNA, 25 nt, Artificial Sequence
  Synthetic
gcgcuccuuuucugaccggauucga

SEQ ID NO: 38 - RNA, 25 nt, Artificial Sequence
  Synthetic
cuccuuuucugaccggcuuagaguc

SEQ ID NO: 39 - RNA, 25 nt, Artificial Sequence
  Synthetic
uccuuuucugaccggcuucaaguca

SEQ ID NO: 40 - RNA, 25 nt, Artificial Sequence
  Synthetic
ccuuuucugaccggcuucgagucac

SEQ ID NO: 41 - RNA, 25 nt, Artificial Sequence
  Synthetic
cuuuucugaccggcuucgaaucacg

SEQ ID NO: 42 - RNA, 25 nt, Artificial Sequence
  Synthetic
uuucugaccggcuucgaguaacgcc

SEQ ID NO: 43 - RNA, 25 nt, Artificial Sequence
  Synthetic
ucugaccggcuucgagucaagccuu

SEQ ID NO: 44 - RNA, 25 nt, Artificial Sequence
  Synthetic
cugaccggcuucgagucacaccuug

SEQ ID NO: 45 - RNA, 25 nt, Artificial Sequence
  Synthetic
ugaccggcuucgagucacgacuugg

SEQ ID NO: 46 - RNA, 25 nt, Artificial Sequence
  Synthetic
ggugaugcuucuggagacaacucgg

SEQ ID NO: 47 - RNA, 25 nt, Artificial Sequence
  Synthetic
ugaugcuucuggagacaucacggag

SEQ ID NO: 48 - RNA, 25 nt, Artificial Sequence
  Synthetic
gaugcuucuggagacaucuaggagg

SEQ ID NO: 49 - RNA, 25 nt, Artificial Sequence
  Synthetic
augcuucuggagacaucucagaggu

SEQ ID NO: 50 - RNA, 25 nt, Artificial Sequence
  Synthetic
ugcuucuggagacaucucgaaggua

SEQ ID NO: 51 - RNA, 25 nt, Artificial Sequence
  Synthetic
gcuucuggagacaucucggagguac

SEQ ID NO: 52 - RNA, 25 nt, Artificial Sequence
  Synthetic
cuucuggagacaucucggaaguaca

SEQ ID NO: 53 - RNA, 25 nt, Artificial Sequence
  Synthetic
uucuggagacaucucggagauacaa

SEQ ID NO: 54 - RNA, 25 nt, Artificial Sequence
  Synthetic
ucuggagacaucucggaggaacaac

SEQ ID NO: 55 - RNA, 25 nt, Artificial Sequence
  Synthetic
cuggagacaucucggagguacaacc

SEQ ID NO: 56 - RNA, 25 nt, Artificial Sequence
  Synthetic
uggagacaucucggagguaaaaccc

SEQ ID NO: 57 - RNA, 25 nt, Artificial Sequence
  Synthetic
ggagacaucucggagguacaacccu

SEQ ID NO: 58 - RNA, 25 nt, Artificial Sequence
  Synthetic
gagacaucucggagguacaacccug

SEQ ID NO: 59 - RNA, 25 nt, Artificial Sequence
  Synthetic
agacaucucggagguacaaaccugg

SEQ ID NO: 60 - RNA, 25 nt, Artificial Sequence
  Synthetic
gacaucucggagguacaacacuggg

SEQ ID NO: 61 - RNA, 25 nt, Artificial Sequence
  Synthetic
acaucucggagguacaaccauggga

SEQ ID NO: 62 - RNA, 25 nt, Artificial Sequence
  Synthetic
aucucggagguacaacccuaggagu

SEQ ID NO: 63 - RNA, 25 nt, Artificial Sequence
  Synthetic
ucucggagguacaacccugagagug

SEQ ID NO: 64 - RNA, 25 nt, Artificial Sequence
  Synthetic
cucggagguacaacccuggaaguga

SEQ ID NO: 65 - RNA, 25 nt, Artificial Sequence
  Synthetic
cggagguacaacccugggaaugaga

SEQ ID NO: 66 - RNA, 25 nt, Artificial Sequence
  Synthetic
gagguacaacccugggaguaagagu

SEQ ID NO: 67 - RNA, 25 nt, Artificial Sequence
  Synthetic
agguacaacccugggagugagagua

SEQ ID NO: 68 - RNA, 25 nt, Artificial Sequence
  Synthetic
gguacaacccugggagugaaaguau

SEQ ID NO: 69 - RNA, 25 nt, Artificial Sequence
  Synthetic
guacaacccugggagugagaguauc

SEQ ID NO: 70 - RNA, 25 nt, Artificial Sequence
  Synthetic
uacaacccugggagugagaauauca

SEQ ID NO: 71 - RNA, 25 nt, Artificial Sequence
  Synthetic
acaacccugggagugagagaaucac

SEQ ID NO: 72 - RNA, 25 nt, Artificial Sequence
  Synthetic
caacccugggagugagaguaucacc

SEQ ID NO: 73 - RNA, 25 nt, Artificial Sequence
  Synthetic
aacccugggagugagaguaacaccu

SEQ ID NO: 74 - RNA, 25 nt, Artificial Sequence
  Synthetic
acccugggagugagaguauaaccuu

SEQ ID NO: 75 - RNA, 25 nt, Artificial Sequence
  Synthetic
cccugggagugagaguaucaccuuc

SEQ ID NO: 76 - RNA, 25 nt, Artificial Sequence
  Synthetic
ccugggagugagaguaucaacuucc

SEQ ID NO: 77 - RNA, 25 nt, Artificial Sequence
  Synthetic
cugggagugagaguaucacauuccu

SEQ ID NO: 78 - RNA, 25 nt, Artificial Sequence
  Synthetic
ugggagugagaguaucaccauccuc

SEQ ID NO: 79 - RNA, 25 nt, Artificial Sequence
  Synthetic
gggagugagaguaucaccuaccuca

SEQ ID NO: 80 - RNA, 25 nt, Artificial Sequence
  Synthetic
gagugagaguaucaccuucaucaag

SEQ ID NO: 81 - RNA, 25 nt, Artificial Sequence
  Synthetic
agugagaguaucaccuuccacaagg

SEQ ID NO: 82 - RNA, 25 nt, Artificial Sequence
  Synthetic
gugagaguaucaccuuccuaaagga

SEQ ID NO: 83 - RNA, 25 nt, Artificial Sequence
  Synthetic
ugagaguaucaccuuccucaaggau

SEQ ID NO: 84 - RNA, 25 nt, Artificial Sequence
  Synthetic
gagaguaucaccuuccucaaggauu

SEQ ID NO: 85 - RNA, 25 nt, Artificial Sequence
  Synthetic
gaguaucaccuuccucaagaauuuc

SEQ ID NO: 86 - RNA, 25 nt, Artificial Sequence
  Synthetic
aguaucaccuuccucaaggauuuca

SEQ ID NO: 87 - RNA, 25 nt, Artificial Sequence
  Synthetic
guaucaccuuccucaaggaauucag

SEQ ID NO: 88 - RNA, 25 nt, Artificial Sequence
  Synthetic
uaucaccuuccucaaggauaucagu

SEQ ID NO: 89 - RNA, 25 nt, Artificial Sequence
  Synthetic
aucaccuuccucaaggauuacaguu

SEQ ID NO: 90 - RNA, 25 nt, Artificial Sequence
  Synthetic
accuuccucaaggauuucaauuaua

SEQ ID NO: 91 - RNA, 25 nt, Artificial Sequence
  Synthetic
ccuuccucaaggauuucagauauaa

SEQ ID NO: 92 - RNA, 25 nt, Artificial Sequence
  Synthetic
uccucaaggauuucaguuaaaaccg

SEQ ID NO: 93 - RNA, 25 nt, Artificial Sequence
  Synthetic
caaggauuucaguuauaacagggaa

SEQ ID NO: 94 - RNA, 25 nt, Artificial Sequence
  Synthetic
aaggauuucaguuauaaccaggaag

SEQ ID NO: 95 - RNA, 25 nt, Artificial Sequence
  Synthetic
aggauuucaguuauaaccgagaaga

SEQ ID NO: 96 - RNA, 25 nt, Artificial Sequence
  Synthetic
ggauuucaguuauaaccggaaagac

SEQ ID NO: 97 - RNA, 25 nt, Artificial Sequence
  Synthetic
gauuucaguuauaaccgggaagacu

SEQ ID NO: 98 - RNA, 25 nt, Artificial Sequence
  Synthetic
auuucaguuauaaccgggaagacuu

SEQ ID NO: 99 - RNA, 25 nt, Artificial Sequence
  Synthetic
uuucaguuauaaccgggaaaacuuu

SEQ ID NO: 100 - RNA, 25 nt, Artificial Sequence
  Synthetic
uucaguuauaaccgggaagacuuug

SEQ ID NO: 101 - RNA, 25 nt, Artificial Sequence
  Synthetic
ucaguuauaaccgggaagaauuugc

SEQ ID NO: 102 - RNA, 25 nt, Artificial Sequence
  Synthetic
caguuauaaccgggaagacauugcc

SEQ ID NO: 103 - RNA, 25 nt, Artificial Sequence
  Synthetic
guuauaaccgggaagacuuagccaa

SEQ ID NO: 104 - RNA, 25 nt, Artificial Sequence
  Synthetic
uuauaaccgggaagacuuuaccaaa

SEQ ID NO: 105 - RNA, 25 nt, Artificial Sequence
  Synthetic
uauaaccgggaagacuuugacaaag

SEQ ID NO: 106 - RNA, 25 nt, Artificial Sequence
  Synthetic
auaaccgggaagacuuugcaaaagc

SEQ ID NO: 107 - RNA, 25 nt, Artificial Sequence
  Synthetic
uaaccgggaagacuuugccaaagca

SEQ ID NO: 108 - RNA, 25 nt, Artificial Sequence
  Synthetic
aaccgggaagacuuugccaaagcag

SEQ ID NO: 109 - RNA, 25 nt, Artificial Sequence
  Synthetic
accgggaagacuuugccaaagcagg

SEQ ID NO: 110 - RNA, 25 nt, Artificial Sequence
  Synthetic
ccgggaagacuuugccaaaacaggg

SEQ ID NO: 111 - RNA, 25 nt, Artificial Sequence
  Synthetic
ggaagacuuugccaaagcaaggcug

SEQ ID NO: 112 - RNA, 25 nt, Artificial Sequence
  Synthetic
gaagacuuugccaaagcagagcugc

SEQ ID NO: 113 - RNA, 25 nt, Artificial Sequence
  Synthetic
aagacuuugccaaagcaggacugca

SEQ ID NO: 114 - RNA, 25 nt, Artificial Sequence
  Synthetic
agacuuugccaaagcagggaugcaa

SEQ ID NO: 115 - RNA, 25 nt, Artificial Sequence
  Synthetic
gacuuugccaaagcagggcagcaag

SEQ ID NO: 116 - RNA, 25 nt, Artificial Sequence
  Synthetic
acuuugccaaagcagggcuacaagu

SEQ ID NO: 117 - RNA, 25 nt, Artificial Sequence
  Synthetic
cuuugccaaagcagggcugaaagug

SEQ ID NO: 118 - RNA, 25 nt, Artificial Sequence
  Synthetic
ugccaaagcagggcugcaaauggaa

SEQ ID NO: 119 - RNA, 25 nt, Artificial Sequence
  Synthetic
gccaaagcagggcugcaagaggaau

SEQ ID NO: 120 - RNA, 25 nt, Artificial Sequence
  Synthetic
ccaaagcagggcugcaaguagaauu

SEQ ID NO: 121 - RNA, 25 nt, Artificial Sequence
  Synthetic
caaagcagggcugcaagugaaauuc

SEQ ID NO: 122 - RNA, 25 nt, Artificial Sequence
  Synthetic
aaagcagggcugcaaguggaauuca

SEQ ID NO: 123 - RNA, 25 nt, Artificial Sequence
  Synthetic
aagcagggcugcaaguggaauucau

SEQ ID NO: 124 - RNA, 25 nt, Artificial Sequence
  Synthetic
agcagggcugcaaguggaaaucauc

SEQ ID NO: 125 - RNA, 25 nt, Artificial Sequence
  Synthetic
gcagggcugcaaguggaauacauca

SEQ ID NO: 126 - RNA, 25 nt, Artificial Sequence
  Synthetic
agggcugcaaguggaauucaucaac

SEQ ID NO: 127 - RNA, 25 nt, Artificial Sequence
  Synthetic
gggcugcaaguggaauucaacaacc

SEQ ID NO: 128 - RNA, 25 nt, Artificial Sequence
  Synthetic
ggcugcaaguggaauucauaaaccc

SEQ ID NO: 129 - RNA, 25 nt, Artificial Sequence
  Synthetic
gcugcaaguggaauucaucaacccc

SEQ ID NO: 130 - RNA, 25 nt, Artificial Sequence
  Synthetic
gcaaguggaauucaucaacaccauc

SEQ ID NO: 131 - RNA, 25 nt, Artificial Sequence
  Synthetic
aaguggaauucaucaacccaaucuu

SEQ ID NO: 132 - RNA, 25 nt, Artificial Sequence
  Synthetic
aguggaauucaucaaccccaucuuc

SEQ ID NO: 133 - RNA, 25 nt, Artificial Sequence
  Synthetic
uggaauucaucaaccccauauucga

SEQ ID NO: 134 - RNA, 25 nt, Artificial Sequence
  Synthetic
ggaauucaucaaccccaucaucgag

SEQ ID NO: 135 - RNA, 25 nt, Artificial Sequence
  Synthetic
auucaucaaccccaucuucaaguuc

SEQ ID NO: 136 - RNA, 25 nt, Artificial Sequence
  Synthetic
uucaucaaccccaucuucgaguucu

SEQ ID NO: 137 - RNA, 25 nt, Artificial Sequence
  Synthetic
ucaucaaccccaucuucgaauucuc

SEQ ID NO: 138 - RNA, 25 nt, Artificial Sequence
  Synthetic
caucaaccccaucuucgagaucucc

SEQ ID NO: 139 - RNA, 25 nt, Artificial Sequence
  Synthetic
aucaaccccaucuucgaguacucca

SEQ ID NO: 140 - RNA, 25 nt, Artificial Sequence
  Synthetic
ucaaccccaucuucgaguuauccag

SEQ ID NO: 141 - RNA, 25 nt, Artificial Sequence
  Synthetic
caaccccaucuucgaguucaccagg

SEQ ID NO: 142 - RNA, 25 nt, Artificial Sequence
  Synthetic
aaccccaucuucgaguucuacaggg

SEQ ID NO: 143 - RNA, 25 nt, Artificial Sequence
  Synthetic
accccaucuucgaguucucaagggc

SEQ ID NO: 144 - RNA, 25 nt, Artificial Sequence
  Synthetic
cccaucuucgaguucuccaaggcca

SEQ ID NO: 145 - RNA, 25 nt, Artificial Sequence
  Synthetic
ccaucuucgaguucuccagagccau

SEQ ID NO: 146 - RNA, 25 nt, Artificial Sequence
  Synthetic
caucuucgaguucuccaggaccaug

SEQ ID NO: 147 - RNA, 25 nt, Artificial Sequence
  Synthetic
aucuucgaguucuccagggacauga

SEQ ID NO: 148 - RNA, 25 nt, Artificial Sequence
  Synthetic
ucuucgaguucuccagggcaaugaa

SEQ ID NO: 149 - RNA, 25 nt, Artificial Sequence
  Synthetic
cuucgaguucuccagggccaugaau

SEQ ID NO: 150 - RNA, 25 nt, Artificial Sequence
  Synthetic
uucgaguucuccagggccaagaaug

SEQ ID NO: 151 - RNA, 25 nt, Artificial Sequence
  Synthetic
ucgaguucuccagggccauaaauga

SEQ ID NO: 152 - RNA, 25 nt, Artificial Sequence
  Synthetic
cgaguucuccagggccaugaaugag

SEQ ID NO: 153 - RNA, 25 nt, Artificial Sequence
  Synthetic
gaguucuccagggccaugaaugagc

SEQ ID NO: 154 - RNA, 25 nt, Artificial Sequence
  Synthetic
aguucuccagggccaugaaagagcu

SEQ ID NO: 155 - RNA, 25 nt, Artificial Sequence
  Synthetic
guucuccagggccaugaauaagcug

SEQ ID NO: 156 - RNA, 25 nt, Artificial Sequence
  Synthetic
ucuccagggccaugaaugaacugca

SEQ ID NO: 157 - RNA, 25 nt, Artificial Sequence
  Synthetic
cuccagggccaugaaugagaugcaa

SEQ ID NO: 158 - RNA, 25 nt, Artificial Sequence
  Synthetic
uccagggccaugaaugagcagcaac

SEQ ID NO: 159 - RNA, 25 nt, Artificial Sequence
  Synthetic
ccagggccaugaaugagcuacaacu

SEQ ID NO: 160 - RNA, 25 nt, Artificial Sequence
  Synthetic
cagggccaugaaugagcugaaacuc

SEQ ID NO: 161 - RNA, 25 nt, Artificial Sequence
  Synthetic
agggccaugaaugagcugcaacuca

SEQ ID NO: 162 - RNA, 25 nt, Artificial Sequence
  Synthetic
gggccaugaaugagcugcaacucaa

SEQ ID NO: 163 - RNA, 25 nt, Artificial Sequence
  Synthetic
ggccaugaaugagcugcaaaucaau

SEQ ID NO: 164 - RNA, 25 nt, Artificial Sequence
  Synthetic
gccaugaaugagcugcaacacaaug

SEQ ID NO: 165 - RNA, 25 nt, Artificial Sequence
  Synthetic
ccaugaaugagcugcaacuaaauga

SEQ ID NO: 166 - RNA, 25 nt, Artificial Sequence
  Synthetic
cucauugcuaucagcaucuacucug

SEQ ID NO: 167 - RNA, 25 nt, Artificial Sequence
  Synthetic
ucauugcuaucagcaucuuaucugc

SEQ ID NO: 168 - RNA, 25 nt, Artificial Sequence
  Synthetic
cauugcuaucagcaucuucacugca

SEQ ID NO: 169 - RNA, 25 nt, Artificial Sequence
  Synthetic
auugcuaucagcaucuucuaugcag

SEQ ID NO: 170 - RNA, 25 nt, Artificial Sequence
  Synthetic
uugcuaucagcaucuucucagcaga

SEQ ID NO: 171 - RNA, 25 nt, Artificial Sequence
  Synthetic
ugcuaucagcaucuucucuacagac

SEQ ID NO: 172 - RNA, 25 nt, Artificial Sequence
  Synthetic
gcuaucagcaucuucucugaagacc

SEQ ID NO: 173 - RNA, 25 nt, Artificial Sequence
  Synthetic
cuaucagcaucuucucugcagaccg

SEQ ID NO: 174 - RNA, 25 nt, Artificial Sequence
  Synthetic
uaucagcaucuucucugcaaaccgg

SEQ ID NO: 175 - RNA, 25 nt, Artificial Sequence
  Synthetic
aucagcaucuucucugcagaccggc

SEQ ID NO: 176 - RNA, 25 nt, Artificial Sequence
  Synthetic
gugcaggaccagcuccaggaagaga

SEQ ID NO: 177 - RNA, 25 nt, Artificial Sequence
  Synthetic
gcaggaccagcuccagguaaagagg

SEQ ID NO: 178 - RNA, 25 nt, Artificial Sequence
  Synthetic
gaccagcuccagguagagaagcugc

SEQ ID NO: 179 - RNA, 25 nt, Artificial Sequence
  Synthetic
accagcuccagguagagagacugca

SEQ ID NO: 180 - RNA, 25 nt, Artificial Sequence
  Synthetic
ccagcuccagguagagaggaugcag

SEQ ID NO: 181 - RNA, 25 nt, Artificial Sequence
  Synthetic
agcuccagguagagaggcuacagca

SEQ ID NO: 182 - RNA, 25 nt, Artificial Sequence
  Synthetic
gcuccagguagagaggcugaagcac

SEQ ID NO: 183 - RNA, 25 nt, Artificial Sequence
  Synthetic
ccagguagagaggcugcagaacaca

SEQ ID NO: 184 - RNA, 25 nt, Artificial Sequence
  Synthetic
agguagagaggcugcagcaaacaua

SEQ ID NO: 185 - RNA, 25 nt, Artificial Sequence
  Synthetic
gguagagaggcugcagcacacauau

SEQ ID NO: 186 - RNA, 25 nt, Artificial Sequence
  Synthetic
guagagaggcugcagcacaaauaug

SEQ ID NO: 187 - RNA, 25 nt, Artificial Sequence
  Synthetic
uagagaggcugcagcacacauaugu

SEQ ID NO: 188 - RNA, 25 nt, Artificial Sequence
  Synthetic
agagaggcugcagcacacaaaugug

SEQ ID NO: 189 - RNA, 25 nt, Artificial Sequence
  Synthetic
gagaggcugcagcacacauaugugg

SEQ ID NO: 190 - RNA, 25 nt, Artificial Sequence
  Synthetic
agaggcugcagcacacauaagugga

SEQ ID NO: 191 - RNA, 25 nt, Artificial Sequence
  Synthetic
gaggcugcagcacacauauauggaa

SEQ ID NO: 192 - RNA, 25 nt, Artificial Sequence
  Synthetic
aggcugcagcacacauaugaggaag

SEQ ID NO: 193 - RNA, 25 nt, Artificial Sequence
  Synthetic
ggcugcagcacacauauguagaagc

SEQ ID NO: 194 - RNA, 25 nt, Artificial Sequence
  Synthetic
gcugcagcacacauaugugaaagcc

SEQ ID NO: 195 - RNA, 25 nt, Artificial Sequence
  Synthetic
cugcagcacacauauguggaagccc

SEQ ID NO: 196 - RNA, 25 nt, Artificial Sequence
  Synthetic
gcagcacacauauguggaaacccug

SEQ ID NO: 197 - RNA, 25 nt, Artificial Sequence
  Synthetic
cagcacacauauguggaagaccugc

SEQ ID NO: 198 - RNA, 25 nt, Artificial Sequence
  Synthetic
agcacacauauguggaagcacugca

SEQ ID NO: 199 - RNA, 25 nt, Artificial Sequence
  Synthetic
cacacauauguggaagcccagcaug

SEQ ID NO: 200 - RNA, 25 nt, Artificial Sequence
  Synthetic
acacauauguggaagcccuacaugc

SEQ ID NO: 201 - RNA, 25 nt, Artificial Sequence
  Synthetic
cacauauguggaagcccugaaugcc

SEQ ID NO: 202 - RNA, 25 nt, Artificial Sequence
  Synthetic
acauauguggaagcccugcaugccu

SEQ ID NO: 203 - RNA, 25 nt, Artificial Sequence
  Synthetic
cauauguggaagcccugcaagccua

SEQ ID NO: 204 - RNA, 25 nt, Artificial Sequence
  Synthetic
auauguggaagcccugcauaccuac

SEQ ID NO: 205 - RNA, 25 nt, Artificial Sequence
  Synthetic
uauguggaagcccugcaugacuacg

SEQ ID NO: 206 - RNA, 25 nt, Artificial Sequence
  Synthetic
auguggaagcccugcaugcauacgu

SEQ ID NO: 207 - RNA, 25 nt, Artificial Sequence
  Synthetic
uguggaagcccugcaugccaacguc

SEQ ID NO: 208 - RNA, 25 nt, Artificial Sequence
  Synthetic
guggaagcccugcaugccuacgucu

SEQ ID NO: 209 - RNA, 25 nt, Artificial Sequence
  Synthetic
uggaagcccugcaugccuaagucuc

SEQ ID NO: 210 - RNA, 25 nt, Artificial Sequence
  Synthetic
ggaagcccugcaugccuacaucucc

SEQ ID NO: 211 - RNA, 25 nt, Artificial Sequence
  Synthetic
gaagcccugcaugccuacgacucca

SEQ ID NO: 212 - RNA, 25 nt, Artificial Sequence
  Synthetic
aagcccugcaugccuacguauccau

SEQ ID NO: 213 - RNA, 25 nt, Artificial Sequence
  Synthetic
agcccugcaugccuacgucaccauc

SEQ ID NO: 214 - RNA, 25 nt, Artificial Sequence
  Synthetic
gcccugcaugccuacgucuacaucc

SEQ ID NO: 215 - RNA, 25 nt, Artificial Sequence
  Synthetic
cccugcaugccuacgucucaaucca

SEQ ID NO: 216 - RNA, 25 nt, Artificial Sequence
  Synthetic
ccugcaugccuacgucuccauccac

SEQ ID NO: 217 - RNA, 25 nt, Artificial Sequence
  Synthetic
cugcaugccuacgucuccaaccacc

SEQ ID NO: 218 - RNA, 25 nt, Artificial Sequence
  Synthetic
ugcaugccuacgucuccauacacca

SEQ ID NO: 219 - RNA, 25 nt, Artificial Sequence
  Synthetic
gcaugccuacgucuccaucaaccau

SEQ ID NO: 220 - RNA, 25 nt, Artificial Sequence
  Synthetic
caugccuacgucuccauccaccauc

SEQ ID NO: 221 - RNA, 25 nt, Artificial Sequence
  Synthetic
augccuacgucuccauccaacaucc

SEQ ID NO: 222 - RNA, 25 nt, Artificial Sequence
  Synthetic
ugccuacgucuccauccacaauccc

SEQ ID NO: 223 - RNA, 25 nt, Artificial Sequence
  Synthetic
gccuacgucuccauccaccaucccc

SEQ ID NO: 224 - RNA, 25 nt, Artificial Sequence
  Synthetic
ccuacgucuccauccaccaacccca

SEQ ID NO: 225 - RNA, 25 nt, Artificial Sequence
  Synthetic
cuacgucuccauccaccauacccau

SEQ ID NO: 226 - RNA, 25 nt, Artificial Sequence
  Synthetic
uacgucuccauccaccaucaccaug

SEQ ID NO: 227 - RNA, 25 nt, Artificial Sequence
  Synthetic
acgucuccauccaccauccacauga

SEQ ID NO: 228 - RNA, 25 nt, Artificial Sequence
  Synthetic
cgucuccauccaccaucccaaugac

SEQ ID NO: 229 - RNA, 25 nt, Artificial Sequence
  Synthetic
gucuccauccaccauccccaugacc

SEQ ID NO: 230 - RNA, 25 nt, Artificial Sequence
  Synthetic
cuccauccaccauccccauaaccga

SEQ ID NO: 231 - RNA, 25 nt, Artificial Sequence
  Synthetic
uccauccaccauccccaugaccgac

SEQ ID NO: 232 - RNA, 25 nt, Artificial Sequence
  Synthetic
ccauccaccauccccaugaacgacu

SEQ ID NO: 233 - RNA, 25 nt, Artificial Sequence
  Synthetic
cauccaccauccccaugacagacug

SEQ ID NO: 234 - RNA, 25 nt, Artificial Sequence
  Synthetic
auccaccauccccaugaccaacuga

SEQ ID NO: 235 - RNA, 25 nt, Artificial Sequence
  Synthetic
uccaccauccccaugaccgacugau

SEQ ID NO: 236 - RNA, 25 nt, Artificial Sequence
  Synthetic
ccaccauccccaugaccgaaugaug

SEQ ID NO: 237 - RNA, 25 nt, Artificial Sequence
  Synthetic
caccauccccaugaccgacagaugu

SEQ ID NO: 238 - RNA, 25 nt, Artificial Sequence
  Synthetic
accauccccaugaccgacuaauguu

SEQ ID NO: 239 - RNA, 25 nt, Artificial Sequence
  Synthetic
ccauccccaugaccgacugauguuc

SEQ ID NO: 240 - RNA, 25 nt, Artificial Sequence
  Synthetic
cauccccaugaccgacugaaguucc

SEQ ID NO: 241 - RNA, 25 nt, Artificial Sequence
  Synthetic
auccccaugaccgacugauauuccc

SEQ ID NO: 242 - RNA, 25 nt, Artificial Sequence
  Synthetic
uccccaugaccgacugaugauccca

SEQ ID NO: 243 - RNA, 25 nt, Artificial Sequence
  Synthetic
ccccaugaccgacugauguacccac

SEQ ID NO: 244 - RNA, 25 nt, Artificial Sequence
  Synthetic
cccaugaccgacugauguuaccacg

SEQ ID NO: 245 - RNA, 25 nt, Artificial Sequence
  Synthetic
ccaugaccgacugauguucacacgg

SEQ ID NO: 246 - RNA, 25 nt, Artificial Sequence
  Synthetic
augaccgacugauguucccacggau

SEQ ID NO: 247 - RNA, 25 nt, Artificial Sequence
  Synthetic
ugaccgacugauguucccaaggaug

SEQ ID NO: 248 - RNA, 25 nt, Artificial Sequence
  Synthetic
gaccgacugauguucccacagaugc

SEQ ID NO: 249 - RNA, 25 nt, Artificial Sequence
  Synthetic
accgacugauguucccacgaaugcu

SEQ ID NO: 250 - RNA, 25 nt, Artificial Sequence
  Synthetic
ccgacugauguucccacggaugcua

SEQ ID NO: 251 - RNA, 25 nt, Artificial Sequence
  Synthetic
gacugauguucccacggauacuaau

SEQ ID NO: 252 - RNA, 25 nt, Artificial Sequence
  Synthetic
acugauguucccacggaugauaaug

SEQ ID NO: 253 - RNA, 25 nt, Artificial Sequence
  Synthetic
ugauguucccacggaugcuaaugaa

SEQ ID NO: 254 - RNA, 25 nt, Artificial Sequence
  Synthetic
gauguucccacggaugcuaaugaaa

SEQ ID NO: 255 - RNA, 25 nt, Artificial Sequence
  Synthetic
uguucccacggaugcuaauaaaacu

SEQ ID NO: 256 - RNA, 25 nt, Artificial Sequence
  Synthetic
guucccacggaugcuaaugaaacug

SEQ ID NO: 257 - RNA, 25 nt, Artificial Sequence
  Synthetic
uucccacggaugcuaaugaaacugg

SEQ ID NO: 258 - RNA, 25 nt, Artificial Sequence
  Synthetic
ucccacggaugcuaaugaaacuggu

SEQ ID NO: 259 - RNA, 25 nt, Artificial Sequence
  Synthetic
cccacggaugcuaaugaaaauggug

SEQ ID NO: 260 - RNA, 25 nt, Artificial Sequence
  Synthetic
ccacggaugcuaaugaaacagguga

SEQ ID NO: 261 - RNA, 25 nt, Artificial Sequence
  Synthetic
cacggaugcuaaugaaacuagugag

SEQ ID NO: 262 - RNA, 25 nt, Artificial Sequence
  Synthetic
acggaugcuaaugaaacugaugagc

SEQ ID NO: 263 - RNA, 25 nt, Artificial Sequence
  Synthetic
cggaugcuaaugaaacuggagagcc

SEQ ID NO: 264 - RNA, 25 nt, Artificial Sequence
  Synthetic
ggaugcuaaugaaacugguaagccu

SEQ ID NO: 265 - RNA, 25 nt, Artificial Sequence
  Synthetic
gaugcuaaugaaacuggugagccuc

SEQ ID NO: 266 - RNA, 25 nt, Artificial Sequence
  Synthetic
ugcuaaugaaacuggugagacuccg

SEQ ID NO: 267 - RNA, 25 nt, Artificial Sequence
  Synthetic
gcuaaugaaacuggugagcauccgg

SEQ ID NO: 268 - RNA, 25 nt, Artificial Sequence
  Synthetic
cuaaugaaacuggugagccaccgga

SEQ ID NO: 269 - RNA, 25 nt, Artificial Sequence
  Synthetic
uaaugaaacuggugagccuacggac

SEQ ID NO: 270 - RNA, 25 nt, Artificial Sequence
  Synthetic
aaugaaacuggugagccucaggacc

SEQ ID NO: 271 - RNA, 25 nt, Artificial Sequence
  Synthetic
augaaacuggugagccuccagaccc

SEQ ID NO: 272 - RNA, 25 nt, Artificial Sequence
  Synthetic
ugaaacuggugagccuccgaacccu

SEQ ID NO: 273 - RNA, 25 nt, Artificial Sequence
  Synthetic
aaacuggugagccuccggaaccuga

SEQ ID NO: 274 - RNA, 25 nt, Artificial Sequence
  Synthetic
aacuggugagccuccggacacugag

SEQ ID NO: 275 - RNA, 25 nt, Artificial Sequence
  Synthetic
cuggugagccuccggacccagagca

SEQ ID NO: 276 - RNA, 25 nt, Artificial Sequence
  Synthetic
ccggacccugagcagcgucaacuca

SEQ ID NO: 277 - RNA, 25 nt, Artificial Sequence
  Synthetic
ggacccugagcagcguccaaucaga

SEQ ID NO: 278 - RNA, 25 nt, Artificial Sequence
  Synthetic
gacccugagcagcguccacacagag

SEQ ID NO: 279 - RNA, 25 nt, Artificial Sequence
  Synthetic
acccugagcagcguccacuaagagc

SEQ ID NO: 280 - RNA, 25 nt, Artificial Sequence
  Synthetic
cccugagcagcguccacucagagca

SEQ ID NO: 281 - RNA, 25 nt, Artificial Sequence
  Synthetic
ccugagcagcguccacucaaagcaa

SEQ ID NO: 282 - RNA, 25 nt, Artificial Sequence
  Synthetic
cugagcagcguccacucagagcaag

SEQ ID NO: 283 - RNA, 25 nt, Artificial Sequence
  Synthetic
ugagcagcguccacucagaacaagu

SEQ ID NO: 284 - RNA, 25 nt, Artificial Sequence
  Synthetic
gagcagcguccacucagagaaagug

SEQ ID NO: 285 - RNA, 25 nt, Artificial Sequence
  Synthetic
agcagcguccacucagagcaagugu

SEQ ID NO: 286 - RNA, 25 nt, Artificial Sequence
  Synthetic
gcagcguccacucagagcaaguguu

SEQ ID NO: 287 - RNA, 25 nt, Artificial Sequence
  Synthetic
cagcguccacucagagcaaauguuu

SEQ ID NO: 288 - RNA, 25 nt, Artificial Sequence
  Synthetic
agcguccacucagagcaagaguuug

SEQ ID NO: 289 - RNA, 25 nt, Artificial Sequence
  Synthetic
gcguccacucagagcaaguauuugc

SEQ ID NO: 290 - RNA, 25 nt, Artificial Sequence
  Synthetic
cguccacucagagcaagugauugca

SEQ ID NO: 291 - RNA, 25 nt, Artificial Sequence
  Synthetic
guccacucagagcaaguguaugcac

SEQ ID NO: 292 - RNA, 25 nt, Artificial Sequence
  Synthetic
uccacucagagcaaguguuagcacu

SEQ ID NO: 293 - RNA, 25 nt, Artificial Sequence
  Synthetic
ccacucagagcaaguguuuacacug

SEQ ID NO: 294 - RNA, 25 nt, Artificial Sequence
  Synthetic
acucagagcaaguguuugcacugcg

SEQ ID NO: 295 - RNA, 25 nt, Artificial Sequence
  Synthetic
cucagagcaaguguuugcaaugcgu

SEQ ID NO: 296 - RNA, 25 nt, Artificial Sequence
  Synthetic
ucagagcaaguguuugcacagcguc

SEQ ID NO: 297 - RNA, 25 nt, Artificial Sequence
  Synthetic
cagagcaaguguuugcacuacgucu

SEQ ID NO: 298 - RNA, 25 nt, Artificial Sequence
  Synthetic
agagcaaguguuugcacugagucug

SEQ ID NO: 299 - RNA, 25 nt, Artificial Sequence
  Synthetic
gagcaaguguuugcacugcaucugc

SEQ ID NO: 300 - RNA, 25 nt, Artificial Sequence
  Synthetic
agcaaguguuugcacugcgacugca

SEQ ID NO: 301 - RNA, 25 nt, Artificial Sequence
  Synthetic
gcaaguguuugcacugcguaugcag

SEQ ID NO: 302 - RNA, 25 nt, Artificial Sequence
  Synthetic
caaguguuugcacugcgucagcagg

SEQ ID NO: 303 - RNA, 25 nt, Artificial Sequence
  Synthetic
aaguguuugcacugcgucuacagga

SEQ ID NO: 304 - RNA, 25 nt, Artificial Sequence
  Synthetic
aguguuugcacugcgucugaaggac

SEQ ID NO: 305 - RNA, 25 nt, Artificial Sequence
  Synthetic
guguuugcacugcgucugcaggaca

SEQ ID NO: 306 - RNA, 25 nt, Artificial Sequence
  Synthetic
uguuugcacugcgucugcaagacaa

SEQ ID NO: 307 - RNA, 25 nt, Artificial Sequence
  Synthetic
guuugcacugcgucugcagaacaaa

SEQ ID NO: 308 - RNA, 25 nt, Artificial Sequence
  Synthetic
uuugcacugcgucugcaggacaaaa

SEQ ID NO: 309 - RNA, 25 nt, Artificial Sequence
  Synthetic
uugcacugcgucugcaggaaaaaaa

SEQ ID NO: 310 - RNA, 25 nt, Artificial Sequence
  Synthetic
ugcacugcgucugcaggacaaaaag

SEQ ID NO: 311 - RNA, 25 nt, Artificial Sequence
  Synthetic
gcacugcgucugcaggacaaaaagc

SEQ ID NO: 312 - RNA, 25 nt, Artificial Sequence
  Synthetic
cacugcgucugcaggacaaaaagcu

SEQ ID NO: 313 - RNA, 25 nt, Artificial Sequence
  Synthetic
acugcgucugcaggacaaaaagcuc

SEQ ID NO: 314 - RNA, 25 nt, Artificial Sequence
  Synthetic
cugcgucugcaggacaaaaagcucc

SEQ ID NO: 315 - RNA, 25 nt, Artificial Sequence
  Synthetic
ugcgucugcaggacaaaaaacuccc

SEQ ID NO: 316 - RNA, 25 nt, Artificial Sequence
  Synthetic
gcgucugcaggacaaaaagauccca

SEQ ID NO: 317 - RNA, 25 nt, Artificial Sequence
  Synthetic
cgucugcaggacaaaaagcacccac

SEQ ID NO: 318 - RNA, 25 nt, Artificial Sequence
  Synthetic
gucugcaggacaaaaagcuaccacc

SEQ ID NO: 319 - RNA, 25 nt, Artificial Sequence
  Synthetic
ucugcaggacaaaaagcucacaccg

SEQ ID NO: 320 - RNA, 25 nt, Artificial Sequence
  Synthetic
cugcaggacaaaaagcuccaaccgc

SEQ ID NO: 321 - RNA, 25 nt, Artificial Sequence
  Synthetic
gcaggacaaaaagcucccaacgcug

SEQ ID NO: 322 - RNA, 25 nt, Artificial Sequence
  Synthetic
caggacaaaaagcucccacagcugc

SEQ ID NO: 323 - RNA, 25 nt, Artificial Sequence
  Synthetic
aggacaaaaagcucccaccacugcu

SEQ ID NO: 324 - RNA, 25 nt, Artificial Sequence
  Synthetic
ggacaaaaagcucccaccgaugcuc

SEQ ID NO: 325 - RNA, 25 nt, Artificial Sequence
  Synthetic
acaaaaagcucccaccgcuacucuc

SEQ ID NO: 326 - RNA, 25 nt, Artificial Sequence
  Synthetic
caaaaagcucccaccgcugaucucu

SEQ ID NO: 327 - RNA, 25 nt, Artificial Sequence
  Synthetic
aaaaagcucccaccgcugcacucug

SEQ ID NO: 328 - RNA, 25 nt, Artificial Sequence
  Synthetic
aaaagcucccaccgcugcuaucuga

SEQ ID NO: 329 - RNA, 25 nt, Artificial Sequence
  Synthetic
aaagcucccaccgcugcucacugag

SEQ ID NO: 330 - RNA, 25 nt, Artificial Sequence
  Synthetic
aagcucccaccgcugcucuaugaga

SEQ ID NO: 331 - RNA, 25 nt, Artificial Sequence
  Synthetic
agcucccaccgcugcucucagagau

SEQ ID NO: 332 - RNA, 25 nt, Artificial Sequence
  Synthetic
gcucccaccgcugcucucuaagauc

SEQ ID NO: 333 - RNA, 25 nt, Artificial Sequence
  Synthetic
ucccaccgcugcucucugaaaucug

SEQ ID NO: 334 - RNA, 25 nt, Artificial Sequence
  Synthetic
ccaccgcugcucucugagaacuggg

SEQ ID NO: 335 - RNA, 25 nt, Artificial Sequence
  Synthetic
caccgcugcucucugagauauggga

SEQ ID NO: 336 - RNA, 25 nt, Artificial Sequence
  Synthetic
ccgcugcucucugagaucuaggaug

SEQ ID NO: 337 - RNA, 25 nt, Artificial Sequence
  Synthetic
cgcugcucucugagaucugagaugu

SEQ ID NO: 338 - RNA, 25 nt, Artificial Sequence
  Synthetic
gcugcucucugagaucuggaaugug

SEQ ID NO: 339 - RNA, 25 nt, Artificial Sequence
  Synthetic
gcucucugagaucugggauaugcac

SEQ ID NO: 340 - RNA, 25 nt, Artificial Sequence
  Synthetic
ucucugagaucugggauguacacga

SEQ ID NO: 341 - RNA, 25 nt, Artificial Sequence
  Synthetic
cucugagaucugggaugugaacgaa

SEQ ID NO: 342 - RNA, 25 nt, Artificial Sequence
  Synthetic
ucugagaucugggaugugcacgaau

SEQ ID NO: 343 - RNA, 25 nt, Artificial Sequence
  Synthetic
cugagaucugggaugugcaagaaug

SEQ ID NO: 344 - RNA, 25 nt, Artificial Sequence
  Synthetic
ugagaucugggaugugcacaaauga

SEQ ID NO: 345 - RNA, 25 nt, Artificial Sequence
  Synthetic
gagaucugggaugugcacgaaugac

SEQ ID NO: 346 - RNA, 25 nt, Artificial Sequence
  Synthetic
agaucugggaugugcacgaaugacu

SEQ ID NO: 347 - RNA, 25 nt, Artificial Sequence
  Synthetic
gaucugggaugugcacgaaagacug

SEQ ID NO: 348 - RNA, 25 nt, Artificial Sequence
  Synthetic
aucugggaugugcacgaauaacugu

SEQ ID NO: 349 - RNA, 25 nt, Artificial Sequence
  Synthetic
ucugggaugugcacgaaugacuguu

SEQ ID NO: 350 - RNA, 25 nt, Artificial Sequence
  Synthetic
cugggaugugcacgaaugaauguuc

SEQ ID NO: 351 - RNA, 25 nt, Artificial Sequence
  Synthetic
ugggaugugcacgaaugacaguucu

SEQ ID NO: 352 - RNA, 25 nt, Artificial Sequence
  Synthetic
gggaugugcacgaaugacuauucug

SEQ ID NO: 353 - RNA, 25 nt, Artificial Sequence
  Synthetic
ggaugugcacgaaugacugaucugu

SEQ ID NO: 354 - RNA, 25 nt, Artificial Sequence
  Synthetic
gaugugcacgaaugacuguacuguc

SEQ ID NO: 355 - RNA, 25 nt, Artificial Sequence
  Synthetic
ugguggcugccuccuagaaauggaa

SEQ ID NO: 356 - RNA, 25 nt, Artificial Sequence
  Synthetic
gguggcugccuccuagaagaggaac

SEQ ID NO: 357 - RNA, 25 nt, Artificial Sequence
  Synthetic
guggcugccuccuagaaguagaaca

SEQ ID NO: 358 - RNA, 25 nt, Artificial Sequence
  Synthetic
uggcugccuccuagaagugaaacag

SEQ ID NO: 359 - RNA, 25 nt, Artificial Sequence
  Synthetic
ggcugccuccuagaaguggaacaga

SEQ ID NO: 360 - RNA, 25 nt, Artificial Sequence
  Synthetic
gcugccuccuagaaguggaacagac

SEQ ID NO: 361 - RNA, 25 nt, Artificial Sequence
  Synthetic
cugccuccuagaaguggaaaagacu

SEQ ID NO: 362 - RNA, 25 nt, Artificial Sequence
  Synthetic
ugccuccuagaaguggaacagacug

SEQ ID NO: 363 - RNA, 25 nt, Artificial Sequence
  Synthetic
gccuccuagaaguggaacaaacuga

SEQ ID NO: 364 - RNA, 25 nt, Artificial Sequence
  Synthetic
ccuccuagaaguggaacagacugag

SEQ ID NO: 365 - RNA, 25 nt, Artificial Sequence
  Synthetic
cuccuagaaguggaacagaaugaga

SEQ ID NO: 366 - RNA, 25 nt, Artificial Sequence
  Synthetic
uccuagaaguggaacagacagagaa

SEQ ID NO: 367 - RNA, 25 nt, Artificial Sequence
  Synthetic
ccuagaaguggaacagacuaagaag

SEQ ID NO: 368 - RNA, 25 nt, Artificial Sequence
  Synthetic
cuagaaguggaacagacugagaagg

SEQ ID NO: 369 - RNA, 25 nt, Artificial Sequence
  Synthetic
agaaguggaacagacugagaagggc

SEQ ID NO: 370 - RNA, 25 nt, Artificial Sequence
  Synthetic
ggaacagacugagaagggcaaacau

SEQ ID NO: 371 - RNA, 25 nt, Artificial Sequence
  Synthetic
aacagacugagaagggcaaacauuc

SEQ ID NO: 372 - RNA, 25 nt, Artificial Sequence
  Synthetic
acagacugagaagggcaaaaauucc

SEQ ID NO: 373 - RNA, 25 nt, Artificial Sequence
  Synthetic
cagacugagaagggcaaacauuccu

SEQ ID NO: 374 - RNA, 25 nt, Artificial Sequence
  Synthetic
agacugagaagggcaaacaauccug

SEQ ID NO: 375 - RNA, 25 nt, Artificial Sequence
  Synthetic
gacugagaagggcaaacauaccugg

SEQ ID NO: 376 - RNA, 25 nt, Artificial Sequence
  Synthetic
acugagaagggcaaacauuacuggg

SEQ ID NO: 377 - RNA, 25 nt, Artificial Sequence
  Synthetic
cugagaagggcaaacauucauggga

SEQ ID NO: 378 - RNA, 25 nt, Artificial Sequence
  Synthetic
ugagaagggcaaacauuccagggag

SEQ ID NO: 379 - RNA, 25 nt, Artificial Sequence
  Synthetic
gagaagggcaaacauuccuaggagc

SEQ ID NO: 380 - RNA, 25 nt, Artificial Sequence
  Synthetic
cccguggcauuaaaagagaaucaaa

SEQ ID NO: 381 - RNA, 25 nt, Artificial Sequence
  Synthetic
ccguggcauuaaaagagagacaaag

SEQ ID NO: 382 - RNA, 25 nt, Artificial Sequence
  Synthetic
cguggcauuaaaagagaguaaaagg

SEQ ID NO: 383 - RNA, 25 nt, Artificial Sequence
  Synthetic
guggcauuaaaagagagucaaaggg

SEQ ID NO: 384 - RNA, 25 nt, Artificial Sequence
  Synthetic
uggcauuaaaagagagucaaagggu

SEQ ID NO: 385 - RNA, 27 nt, Artificial Sequence
  Synthetic
gcggaucuguucuucugacaggacaca

SEQ ID NO: 386 - RNA, 27 nt, Artificial Sequence
  Synthetic
aggcguaucuguucuucugacaggaca

SEQ ID NO: 387 - RNA, 27 nt, Artificial Sequence
  Synthetic
ccucuugccgcuucaguuucuucaggc

SEQ ID NO: 388 - RNA, 27 nt, Artificial Sequence
  Synthetic
uccucuugccgcuucaguuucuucagg

SEQ ID NO: 389 - RNA, 27 nt, Artificial Sequence
  Synthetic
cuccuuuugccgcuucaguuucuucag

SEQ ID NO: 390 - RNA, 27 nt, Artificial Sequence
  Synthetic
ccuccucuugccgcuucaguuucuuca

SEQ ID NO: 391 - RNA, 27 nt, Artificial Sequence
  Synthetic
uccucuucuugccgcuucaguuucuuc

SEQ ID NO: 392 - RNA, 27 nt, Artificial Sequence
  Synthetic
guuccuccucuugccgcuucaguuucu

SEQ ID NO: 393 - RNA, 27 nt, Artificial Sequence
  Synthetic
uguucuuccucuugccgcuucaguuuc

SEQ ID NO: 394 - RNA, 27 nt, Artificial Sequence
  Synthetic
cuguuucuccucuugccgcuucaguuu

SEQ ID NO: 395 - RNA, 27 nt, Artificial Sequence
  Synthetic
ccuguuccuccucuugccgcuucaguu

SEQ ID NO: 396 - RNA, 27 nt, Artificial Sequence
  Synthetic
gccuguuccuccucuugccgcuucagu

SEQ ID NO: 397 - RNA, 27 nt, Artificial Sequence
  Synthetic
ugagcuuguuccuccucuugccgcuuc

SEQ ID NO: 398 - RNA, 27 nt, Artificial Sequence
  Synthetic
augagucuguuccuccucuugccgcuu

SEQ ID NO: 399 - RNA, 27 nt, Artificial Sequence
  Synthetic
caugauccuguuccuccucuugccgcu

SEQ ID NO: 400 - RNA, 27 nt, Artificial Sequence
  Synthetic
ggcauuagccuguuccuccucuugccg

SEQ ID NO: 401 - RNA, 27 nt, Artificial Sequence
  Synthetic
guggcuugagccuguuccuccucuugc

SEQ ID NO: 402 - RNA, 27 nt, Artificial Sequence
  Synthetic
ugugguaugagccuguuccuccucuug

SEQ ID NO: 403 - RNA, 27 nt, Artificial Sequence
  Synthetic
augugucaugagccuguuccuccucuu

SEQ ID NO: 404 - RNA, 27 nt, Artificial Sequence
  Synthetic
gauguugcaugagccuguuccuccucu

SEQ ID NO: 405 - RNA, 27 nt, Artificial Sequence
  Synthetic
aggauuuggcaugagccuguuccuccu

SEQ ID NO: 406 - RNA, 27 nt, Artificial Sequence
  Synthetic
auuugugggggugaggaagcccugggg

SEQ ID NO: 407 - RNA, 27 nt, Artificial Sequence
  Synthetic
gcgacuagcuucucgaucaugcccagu

SEQ ID NO: 408 - RNA, 27 nt, Artificial Sequence
  Synthetic
gcagcuacgagcuucucgaucaugccc

SEQ ID NO: 409 - RNA, 27 nt, Artificial Sequence
  Synthetic
gguuauacuguugcugggcagcgacga

SEQ ID NO: 410 - RNA, 27 nt, Artificial Sequence
  Synthetic
ccgguuacacuguugcugggcagcgac

SEQ ID NO: 411 - RNA, 27 nt, Artificial Sequence
  Synthetic
gagcgucgguuacacuguugcugggca

SEQ ID NO: 412 - RNA, 27 nt, Artificial Sequence
  Synthetic
aggagugccgguuacacuguugcuggg

SEQ ID NO: 413 - RNA, 27 nt, Artificial Sequence
  Synthetic
aaggaucgccgguuacacuguugcugg

SEQ ID NO: 414 - RNA, 27 nt, Artificial Sequence
  Synthetic
aaaaguagcgccgguuacacuguugcu

SEQ ID NO: 415 - RNA, 27 nt, Artificial Sequence
  Synthetic
gaaaaugagcgccgguuacacuguugc

SEQ ID NO: 416 - RNA, 27 nt, Artificial Sequence
  Synthetic
agaaauggagcgccgguuacacuguug

SEQ ID NO: 417 - RNA, 27 nt, Artificial Sequence
  Synthetic
cagaauaggagcgccgguuacacuguu

SEQ ID NO: 418 - RNA, 27 nt, Artificial Sequence
  Synthetic
ucagauaaggagcgccgguuacacugu

SEQ ID NO: 419 - RNA, 27 nt, Artificial Sequence
  Synthetic
gucaguaaaggagcgccgguuacacug

SEQ ID NO: 420 - RNA, 27 nt, Artificial Sequence
  Synthetic
ggucauaaaaggagcgccgguuacacu

SEQ ID NO: 421 - RNA, 27 nt, Artificial Sequence
  Synthetic
ucgaauccggucagaaaaggagcgccg

SEQ ID NO: 422 - RNA, 27 nt, Artificial Sequence
  Synthetic
gacucuaagccggucagaaaaggagcg

SEQ ID NO: 423 - RNA, 27 nt, Artificial Sequence
  Synthetic
ugacuugaagccggucagaaaaggagc

SEQ ID NO: 424 - RNA, 27 nt, Artificial Sequence
  Synthetic
gugacucgaagccggucagaaaaggag

SEQ ID NO: 425 - RNA, 27 nt, Artificial Sequence
  Synthetic
cgugauucgaagccggucagaaaagga

SEQ ID NO: 426 - RNA, 27 nt, Artificial Sequence
  Synthetic
ggcguuacucgaagccggucagaaaag

SEQ ID NO: 427 - RNA, 27 nt, Artificial Sequence
  Synthetic
aaggcuugacucgaagccggucagaaa

SEQ ID NO: 428 - RNA, 27 nt, Artificial Sequence
  Synthetic
caaggugugacucgaagccggucagaa

SEQ ID NO: 429 - RNA, 27 nt, Artificial Sequence
  Synthetic
ccaagucgugacucgaagccggucaga

SEQ ID NO: 430 - RNA, 27 nt, Artificial Sequence
  Synthetic
ccgaguugucuccagaagcaucaccug

SEQ ID NO: 431 - RNA, 27 nt, Artificial Sequence
  Synthetic
cuccgugaugucuccagaagcaucacc

SEQ ID NO: 432 - RNA, 27 nt, Artificial Sequence
  Synthetic
ccuccuagaugucuccagaagcaucac

SEQ ID NO: 433 - RNA, 27 nt, Artificial Sequence
  Synthetic
accucugagaugucuccagaagcauca

SEQ ID NO: 434 - RNA, 27 nt, Artificial Sequence
  Synthetic
uaccuucgagaugucuccagaagcauc

SEQ ID NO: 435 - RNA, 27 nt, Artificial Sequence
  Synthetic
guaccuccgagaugucuccagaagcau

SEQ ID NO: 436 - RNA, 27 nt, Artificial Sequence
  Synthetic
uguacuuccgagaugucuccagaagca

SEQ ID NO: 437 - RNA, 27 nt, Artificial Sequence
  Synthetic
uuguaucuccgagaugucuccagaagc

SEQ ID NO: 438 - RNA, 27 nt, Artificial Sequence
  Synthetic
guuguuccuccgagaugucuccagaag

SEQ ID NO: 439 - RNA, 27 nt, Artificial Sequence
  Synthetic
gguuguaccuccgagaugucuccagaa

SEQ ID NO: 440 - RNA, 27 nt, Artificial Sequence
  Synthetic
ggguuuuaccuccgagaugucuccaga

SEQ ID NO: 441 - RNA, 27 nt, Artificial Sequence
  Synthetic
aggguuguaccuccgagaugucuccag

SEQ ID NO: 442 - RNA, 27 nt, Artificial Sequence
  Synthetic
caggguuguaccuccgagaugucucca

SEQ ID NO: 443 - RNA, 27 nt, Artificial Sequence
  Synthetic
ccagguuuguaccuccgagaugucucc

SEQ ID NO: 444 - RNA, 27 nt, Artificial Sequence
  Synthetic
cccaguguuguaccuccgagaugucuc

SEQ ID NO: 445 - RNA, 27 nt, Artificial Sequence
  Synthetic
ucccaugguuguaccuccgagaugucu

SEQ ID NO: 446 - RNA, 27 nt, Artificial Sequence
  Synthetic
acuccuaggguuguaccuccgagaugu

SEQ ID NO: 447 - RNA, 27 nt, Artificial Sequence
  Synthetic
cacucucaggguuguaccuccgagaug

SEQ ID NO: 448 - RNA, 27 nt, Artificial Sequence
  Synthetic
ucacuuccaggguuguaccuccgagau

SEQ ID NO: 449 - RNA, 27 nt, Artificial Sequence
  Synthetic
ucucauucccaggguuguaccuccgag

SEQ ID NO: 450 - RNA, 27 nt, Artificial Sequence
  Synthetic
acucuuacucccaggguuguaccuccg

SEQ ID NO: 451 - RNA, 27 nt, Artificial Sequence
  Synthetic
uacucucacucccaggguuguaccucc

SEQ ID NO: 452 - RNA, 27 nt, Artificial Sequence
  Synthetic
auacuuucacucccaggguuguaccuc

SEQ ID NO: 453 - RNA, 27 nt, Artificial Sequence
  Synthetic
gauacucucacucccaggguuguaccu

SEQ ID NO: 454 - RNA, 27 nt, Artificial Sequence
  Synthetic
ugauauucucacucccaggguuguacc

SEQ ID NO: 455 - RNA, 27 nt, Artificial Sequence
  Synthetic
gugauucucucacucccaggguuguac

SEQ ID NO: 456 - RNA, 27 nt, Artificial Sequence
  Synthetic
ggugauacucucacucccaggguugua

SEQ ID NO: 457 - RNA, 27 nt, Artificial Sequence
  Synthetic
agguguuacucucacucccaggguugu

SEQ ID NO: 458 - RNA, 27 nt, Artificial Sequence
  Synthetic
aagguuauacucucacucccaggguug

SEQ ID NO: 459 - RNA, 27 nt, Artificial Sequence
  Synthetic
gaaggugauacucucacucccaggguu

SEQ ID NO: 460 - RNA, 27 nt, Artificial Sequence
  Synthetic
ggaaguugauacucucacucccagggu

SEQ ID NO: 461 - RNA, 27 nt, Artificial Sequence
  Synthetic
aggaaugugauacucucacucccaggg

SEQ ID NO: 462 - RNA, 27 nt, Artificial Sequence
  Synthetic
gaggauggugauacucucacucccagg

SEQ ID NO: 463 - RNA, 27 nt, Artificial Sequence
  Synthetic
ugagguaggugauacucucacucccag

SEQ ID NO: 464 - RNA, 27 nt, Artificial Sequence
  Synthetic
cuugaugaaggugauacucucacuccc

SEQ ID NO: 465 - RNA, 27 nt, Artificial Sequence
  Synthetic
ccuuguggaaggugauacucucacucc

SEQ ID NO: 466 - RNA, 27 nt, Artificial Sequence
  Synthetic
uccuuuaggaaggugauacucucacuc

SEQ ID NO: 467 - RNA, 27 nt, Artificial Sequence
  Synthetic
auccuugaggaaggugauacucucacu

SEQ ID NO: 468 - RNA, 27 nt, Artificial Sequence
  Synthetic
aauccuugaggaaggugauacucucac

SEQ ID NO: 469 - RNA, 27 nt, Artificial Sequence
  Synthetic
gaaauucuugaggaaggugauacucuc

SEQ ID NO: 470 - RNA, 27 nt, Artificial Sequence
  Synthetic
ugaaauccuugaggaaggugauacucu

SEQ ID NO: 471 - RNA, 27 nt, Artificial Sequence
  Synthetic
cugaauuccuugaggaaggugauacuc

SEQ ID NO: 472 - RNA, 27 nt, Artificial Sequence
  Synthetic
acugauauccuugaggaaggugauacu

SEQ ID NO: 473 - RNA, 27 nt, Artificial Sequence
  Synthetic
aacuguaauccuugaggaaggugauac

SEQ ID NO: 474 - RNA, 27 nt, Artificial Sequence
  Synthetic
uauaauugaaauccuugaggaagguga

SEQ ID NO: 475 - RNA, 27 nt, Artificial Sequence
  Synthetic
uuauaucugaaauccuugaggaaggug

SEQ ID NO: 476 - RNA, 27 nt, Artificial Sequence
  Synthetic
cgguuuuaacugaaauccuugaggaag

SEQ ID NO: 477 - RNA, 27 nt, Artificial Sequence
  Synthetic
uucccuguuauaacugaaauccuugag

SEQ ID NO: 478 - RNA, 27 nt, Artificial Sequence
  Synthetic
cuuccugguuauaacugaaauccuuga

SEQ ID NO: 479 - RNA, 27 nt, Artificial Sequence
  Synthetic
ucuucucgguuauaacugaaauccuug

SEQ ID NO: 480 - RNA, 27 nt, Artificial Sequence
  Synthetic
gucuuuccgguuauaacugaaauccuu

SEQ ID NO: 481 - RNA, 27 nt, Artificial Sequence
  Synthetic
agucuucccgguuauaacugaaauccu

SEQ ID NO: 482 - RNA, 27 nt, Artificial Sequence
  Synthetic
aagucuucccgguuauaacugaaaucc

SEQ ID NO: 483 - RNA, 27 nt, Artificial Sequence
  Synthetic
aaaguuuucccgguuauaacugaaauc

SEQ ID NO: 484 - RNA, 27 nt, Artificial Sequence
  Synthetic
caaagucuucccgguuauaacugaaau

SEQ ID NO: 485 - RNA, 27 nt, Artificial Sequence
  Synthetic
gcaaauucuucccgguuauaacugaaa

SEQ ID NO: 486 - RNA, 27 nt, Artificial Sequence
  Synthetic
ggcaaugucuucccgguuauaacugaa

SEQ ID NO: 487 - RNA, 27 nt, Artificial Sequence
  Synthetic
uuggcuaagucuucccgguuauaacug

SEQ ID NO: 488 - RNA, 27 nt, Artificial Sequence
  Synthetic
uuugguaaagucuucccgguuauaacu

SEQ ID NO: 489 - RNA, 27 nt, Artificial Sequence
  Synthetic
cuuugucaaagucuucccgguuauaac

SEQ ID NO: 490 - RNA, 27 nt, Artificial Sequence
  Synthetic
gcuuuugcaaagucuucccgguuauaa

SEQ ID NO: 491 - RNA, 27 nt, Artificial Sequence
  Synthetic
ugcuuuggcaaagucuucccgguuaua

SEQ ID NO: 492 - RNA, 27 nt, Artificial Sequence
  Synthetic
cugcuuuggcaaagucuucccgguuau

SEQ ID NO: 493 - RNA, 27 nt, Artificial Sequence
  Synthetic
ccugcuuuggcaaagucuucccgguua

SEQ ID NO: 494 - RNA, 27 nt, Artificial Sequence
  Synthetic
cccuguuuuggcaaagucuucccgguu

SEQ ID NO: 495 - RNA, 27 nt, Artificial Sequence
  Synthetic
cagccuugcuuuggcaaagucuucccg

SEQ ID NO: 496 - RNA, 27 nt, Artificial Sequence
  Synthetic
gcagcucugcuuuggcaaagucuuccc

SEQ ID NO: 497 - RNA, 27 nt, Artificial Sequence
  Synthetic
ugcaguccugcuuuggcaaagucuucc

SEQ ID NO: 498 - RNA, 27 nt, Artificial Sequence
  Synthetic
uugcaucccugcuuuggcaaagucuuc

SEQ ID NO: 499 - RNA, 27 nt, Artificial Sequence
  Synthetic
cuugcugcccugcuuuggcaaagucuu

SEQ ID NO: 500 - RNA, 27 nt, Artificial Sequence
  Synthetic
acuuguagcccugcuuuggcaaagucu

SEQ ID NO: 501 - RNA, 27 nt, Artificial Sequence
  Synthetic
cacuuucagcccugcuuuggcaaaguc

SEQ ID NO: 502 - RNA, 27 nt, Artificial Sequence
  Synthetic
uuccauuugcagcccugcuuuggcaaa

SEQ ID NO: 503 - RNA, 27 nt, Artificial Sequence
  Synthetic
auuccucuugcagcccugcuuuggcaa

SEQ ID NO: 504 - RNA, 27 nt, Artificial Sequence
  Synthetic
aauucuacuugcagcccugcuuuggca

SEQ ID NO: 505 - RNA, 27 nt, Artificial Sequence
  Synthetic
gaauuucacuugcagcccugcuuuggc

SEQ ID NO: 506 - RNA, 27 nt, Artificial Sequence
  Synthetic
ugaauuccacuugcagcccugcuuugg

SEQ ID NO: 507 - RNA, 27 nt, Artificial Sequence
  Synthetic
augaauuccacuugcagcccugcuuug

SEQ ID NO: 508 - RNA, 27 nt, Artificial Sequence
  Synthetic
gaugauuuccacuugcagcccugcuuu

SEQ ID NO: 509 - RNA, 27 nt, Artificial Sequence
  Synthetic
ugauguauuccacuugcagcccugcuu

SEQ ID NO: 510 - RNA, 27 nt, Artificial Sequence
  Synthetic
guugaugaauuccacuugcagcccugc

SEQ ID NO: 511 - RNA, 27 nt, Artificial Sequence
  Synthetic
gguuguugaauuccacuugcagcccug

SEQ ID NO: 512 - RNA, 27 nt, Artificial Sequence
  Synthetic
ggguuuaugaauuccacuugcagcccu

SEQ ID NO: 513 - RNA, 27 nt, Artificial Sequence
  Synthetic
gggguugaugaauuccacuugcagccc

SEQ ID NO: 514 - RNA, 27 nt, Artificial Sequence
  Synthetic
gaugguguugaugaauuccacuugcag

SEQ ID NO: 515 - RNA, 27 nt, Artificial Sequence
  Synthetic
aagauuggguugaugaauuccacuugc

SEQ ID NO: 516 - RNA, 27 nt, Artificial Sequence
  Synthetic
gaagaugggguugaugaauuccacuug

SEQ ID NO: 517 - RNA, 27 nt, Artificial Sequence
  Synthetic
ucgaauaugggguugaugaauuccacu

SEQ ID NO: 518 - RNA, 27 nt, Artificial Sequence
  Synthetic
cucgaugaugggguugaugaauuccac

SEQ ID NO: 519 - RNA, 27 nt, Artificial Sequence
  Synthetic
gaacuugaagaugggguugaugaauuc

SEQ ID NO: 520 - RNA, 27 nt, Artificial Sequence
  Synthetic
agaacucgaagaugggguugaugaauu

SEQ ID NO: 521 - RNA, 27 nt, Artificial Sequence
  Synthetic
gagaauucgaagaugggguugaugaau

SEQ ID NO: 522 - RNA, 27 nt, Artificial Sequence
  Synthetic
ggagaucucgaagaugggguugaugaa

SEQ ID NO: 523 - RNA, 27 nt, Artificial Sequence
  Synthetic
uggaguacucgaagaugggguugauga

SEQ ID NO: 524 - RNA, 27 nt, Artificial Sequence
  Synthetic
cuggauaacucgaagaugggguugaug

SEQ ID NO: 525 - RNA, 27 nt, Artificial Sequence
  Synthetic
ccuggugaacucgaagaugggguugau

SEQ ID NO: 526 - RNA, 27 nt, Artificial Sequence
  Synthetic
cccuguagaacucgaagaugggguuga

SEQ ID NO: 527 - RNA, 27 nt, Artificial Sequence
  Synthetic
gcccuugagaacucgaagaugggguug

SEQ ID NO: 528 - RNA, 27 nt, Artificial Sequence
  Synthetic
uggccuuggagaacucgaagauggggu

SEQ ID NO: 529 - RNA, 27 nt, Artificial Sequence
  Synthetic
auggcucuggagaacucgaagaugggg

SEQ ID NO: 530 - RNA, 27 nt, Artificial Sequence
  Synthetic
caugguccuggagaacucgaagauggg

SEQ ID NO: 531 - RNA, 27 nt, Artificial Sequence
  Synthetic
ucaugucccuggagaacucgaagaugg

SEQ ID NO: 532 - RNA, 27 nt, Artificial Sequence
  Synthetic
uucauugcccuggagaacucgaagaug

SEQ ID NO: 533 - RNA, 27 nt, Artificial Sequence
  Synthetic
auucauggcccuggagaacucgaagau

SEQ ID NO: 534 - RNA, 27 nt, Artificial Sequence
  Synthetic
cauucuuggcccuggagaacucgaaga

SEQ ID NO: 535 - RNA, 27 nt, Artificial Sequence
  Synthetic
ucauuuauggcccuggagaacucgaag

SEQ ID NO: 536 - RNA, 27 nt, Artificial Sequence
  Synthetic
cucauucauggcccuggagaacucgaa

SEQ ID NO: 537 - RNA, 27 nt, Artificial Sequence
  Synthetic
gcucauucauggcccuggagaacucga

SEQ ID NO: 538 - RNA, 27 nt, Artificial Sequence
  Synthetic
agcucuuucauggcccuggagaacucg

SEQ ID NO: 539 - RNA, 27 nt, Artificial Sequence
  Synthetic
cagcuuauucauggcccuggagaacuc

SEQ ID NO: 540 - RNA, 27 nt, Artificial Sequence
  Synthetic
ugcaguucauucauggcccuggagaac

SEQ ID NO: 541 - RNA, 27 nt, Artificial Sequence
  Synthetic
uugcaucucauucauggcccuggagaa

SEQ ID NO: 542 - RNA, 27 nt, Artificial Sequence
  Synthetic
guugcugcucauucauggcccuggaga

SEQ ID NO: 543 - RNA, 27 nt, Artificial Sequence
  Synthetic
aguuguagcucauucauggcccuggag

SEQ ID NO: 544 - RNA, 27 nt, Artificial Sequence
  Synthetic
gaguuucagcucauucauggcccugga

SEQ ID NO: 545 - RNA, 27 nt, Artificial Sequence
  Synthetic
ugaguugcagcucauucauggcccugg

SEQ ID NO: 546 - RNA, 27 nt, Artificial Sequence
  Synthetic
uugaguugcagcucauucauggcccug

SEQ ID NO: 547 - RNA, 27 nt, Artificial Sequence
  Synthetic
auugauuugcagcucauucauggcccu

SEQ ID NO: 548 - RNA, 27 nt, Artificial Sequence
  Synthetic
cauuguguugcagcucauucauggccc

SEQ ID NO: 549 - RNA, 27 nt, Artificial Sequence
  Synthetic
ucauuuaguugcagcucauucauggcc

SEQ ID NO: 550 - RNA, 27 nt, Artificial Sequence
  Synthetic
cagaguagaugcugauagcaaugagca

SEQ ID NO: 551 - RNA, 27 nt, Artificial Sequence
  Synthetic
gcagauaagaugcugauagcaaugagc

SEQ ID NO: 552 - RNA, 27 nt, Artificial Sequence
  Synthetic
ugcagugaagaugcugauagcaaugag

SEQ ID NO: 553 - RNA, 27 nt, Artificial Sequence
  Synthetic
cugcauagaagaugcugauagcaauga

SEQ ID NO: 554 - RNA, 27 nt, Artificial Sequence
  Synthetic
ucugcugagaagaugcugauagcaaug

SEQ ID NO: 555 - RNA, 27 nt, Artificial Sequence
  Synthetic
gucuguagagaagaugcugauagcaau

SEQ ID NO: 556 - RNA, 27 nt, Artificial Sequence
  Synthetic
ggucuucagagaagaugcugauagcaa

SEQ ID NO: 557 - RNA, 27 nt, Artificial Sequence
  Synthetic
cggucugcagagaagaugcugauagca

SEQ ID NO: 558 - RNA, 27 nt, Artificial Sequence
  Synthetic
ccgguuugcagagaagaugcugauagc

SEQ ID NO: 559 - RNA, 27 nt, Artificial Sequence
  Synthetic
gccggucugcagagaagaugcugauag

SEQ ID NO: 560 - RNA, 27 nt, Artificial Sequence
  Synthetic
ucucuuccuggagcugguccugcacgu

SEQ ID NO: 561 - RNA, 27 nt, Artificial Sequence
  Synthetic
ccucuuuaccuggagcugguccugcac

SEQ ID NO: 562 - RNA, 27 nt, Artificial Sequence
  Synthetic
gcagcuucucuaccuggagcugguccu

SEQ ID NO: 563 - RNA, 27 nt, Artificial Sequence
  Synthetic
ugcagucucucuaccuggagcuggucc

SEQ ID NO: 564 - RNA, 27 nt, Artificial Sequence
  Synthetic
cugcauccucucuaccuggagcugguc

SEQ ID NO: 565 - RNA, 27 nt, Artificial Sequence
  Synthetic
ugcuguagccucucuaccuggagcugg

SEQ ID NO: 566 - RNA, 27 nt, Artificial Sequence
  Synthetic
gugcuucagccucucuaccuggagcug

SEQ ID NO: 567 - RNA, 27 nt, Artificial Sequence
  Synthetic
uguguucugcagccucucuaccuggag

SEQ ID NO: 568 - RNA, 27 nt, Artificial Sequence
  Synthetic
uauguuugcugcagccucucuaccugg

SEQ ID NO: 569 - RNA, 27 nt, Artificial Sequence
  Synthetic
auaugugugcugcagccucucuaccug

SEQ ID NO: 570 - RNA, 27 nt, Artificial Sequence
  Synthetic
cauauuugugcugcagccucucuaccu

SEQ ID NO: 571 - RNA, 27 nt, Artificial Sequence
  Synthetic
acauaugugugcugcagccucucuacc

SEQ ID NO: 572 - RNA, 27 nt, Artificial Sequence
  Synthetic
cacauuugugugcugcagccucucuac

SEQ ID NO: 573 - RNA, 27 nt, Artificial Sequence
  Synthetic
ccacauaugugugcugcagccucucua

SEQ ID NO: 574 - RNA, 27 nt, Artificial Sequence
  Synthetic
uccacuuaugugugcugcagccucucu

SEQ ID NO: 575 - RNA, 27 nt, Artificial Sequence
  Synthetic
uuccauauaugugugcugcagccucuc

SEQ ID NO: 576 - RNA, 27 nt, Artificial Sequence
  Synthetic
cuuccucauaugugugcugcagccucu

SEQ ID NO: 577 - RNA, 27 nt, Artificial Sequence
  Synthetic
gcuucuacauaugugugcugcagccuc

SEQ ID NO: 578 - RNA, 27 nt, Artificial Sequence
  Synthetic
ggcuuucacauaugugugcugcagccu

SEQ ID NO: 579 - RNA, 27 nt, Artificial Sequence
  Synthetic
gggcuuccacauaugugugcugcagcc

SEQ ID NO: 580 - RNA, 27 nt, Artificial Sequence
  Synthetic
caggguuuccacauaugugugcugcag

SEQ ID NO: 581 - RNA, 27 nt, Artificial Sequence
  Synthetic
gcaggucuuccacauaugugugcugca

SEQ ID NO: 582 - RNA, 27 nt, Artificial Sequence
  Synthetic
ugcagugcuuccacauaugugugcugc

SEQ ID NO: 583 - RNA, 27 nt, Artificial Sequence
  Synthetic
caugcugggcuuccacauaugugugcu

SEQ ID NO: 584 - RNA, 27 nt, Artificial Sequence
  Synthetic
gcauguagggcuuccacauaugugugc

SEQ ID NO: 585 - RNA, 27 nt, Artificial Sequence
  Synthetic
ggcauucagggcuuccacauaugugug

SEQ ID NO: 586 - RNA, 27 nt, Artificial Sequence
  Synthetic
aggcaugcagggcuuccacauaugugu

SEQ ID NO: 587 - RNA, 27 nt, Artificial Sequence
  Synthetic
uaggcuugcagggcuuccacauaugug

SEQ ID NO: 588 - RNA, 27 nt, Artificial Sequence
  Synthetic
guagguaugcagggcuuccacauaugu

SEQ ID NO: 589 - RNA, 27 nt, Artificial Sequence
  Synthetic
cguagucaugcagggcuuccacauaug

SEQ ID NO: 590 - RNA, 27 nt, Artificial Sequence
  Synthetic
acguaugcaugcagggcuuccacauau

SEQ ID NO: 591 - RNA, 27 nt, Artificial Sequence
  Synthetic
gacguuggcaugcagggcuuccacaua

SEQ ID NO: 592 - RNA, 27 nt, Artificial Sequence
  Synthetic
agacguaggcaugcagggcuuccacau

SEQ ID NO: 593 - RNA, 27 nt, Artificial Sequence
  Synthetic
gagacuuaggcaugcagggcuuccaca

SEQ ID NO: 594 - RNA, 27 nt, Artificial Sequence
  Synthetic
ggagauguaggcaugcagggcuuccac

SEQ ID NO: 595 - RNA, 27 nt, Artificial Sequence
  Synthetic
uggagucguaggcaugcagggcuucca

SEQ ID NO: 596 - RNA, 27 nt, Artificial Sequence
  Synthetic
auggauacguaggcaugcagggcuucc

SEQ ID NO: 597 - RNA, 27 nt, Artificial Sequence
  Synthetic
gauggugacguaggcaugcagggcuuc

SEQ ID NO: 598 - RNA, 27 nt, Artificial Sequence
  Synthetic
ggauguagacguaggcaugcagggcuu

SEQ ID NO: 599 - RNA, 27 nt, Artificial Sequence
  Synthetic
uggauugagacguaggcaugcagggcu

SEQ ID NO: 600 - RNA, 27 nt, Artificial Sequence
  Synthetic
guggauggagacguaggcaugcagggc

SEQ ID NO: 601 - RNA, 27 nt, Artificial Sequence
  Synthetic
ggugguuggagacguaggcaugcaggg

SEQ ID NO: 602 - RNA, 27 nt, Artificial Sequence
  Synthetic
ugguguauggagacguaggcaugcagg

SEQ ID NO: 603 - RNA, 27 nt, Artificial Sequence
  Synthetic
augguugauggagacguaggcaugcag

SEQ ID NO: 604 - RNA, 27 nt, Artificial Sequence
  Synthetic
gaugguggauggagacguaggcaugca

SEQ ID NO: 605 - RNA, 27 nt, Artificial Sequence
  Synthetic
ggauguuggauggagacguaggcaugc

SEQ ID NO: 606 - RNA, 27 nt, Artificial Sequence
  Synthetic
gggauuguggauggagacguaggcaug

SEQ ID NO: 607 - RNA, 27 nt, Artificial Sequence
  Synthetic
ggggaugguggauggagacguaggcau

SEQ ID NO: 608 - RNA, 27 nt, Artificial Sequence
  Synthetic
ugggguugguggauggagacguaggca

SEQ ID NO: 609 - RNA, 27 nt, Artificial Sequence
  Synthetic
auggguaugguggauggagacguaggc

SEQ ID NO: 610 - RNA, 27 nt, Artificial Sequence
  Synthetic
cauggugaugguggauggagacguagg

SEQ ID NO: 611 - RNA, 27 nt, Artificial Sequence
  Synthetic
ucauguggaugguggauggagacguag

SEQ ID NO: 612 - RNA, 27 nt, Artificial Sequence
  Synthetic
gucauugggaugguggauggagacgua

SEQ ID NO: 613 - RNA, 27 nt, Artificial Sequence
  Synthetic
ggucauggggaugguggauggagacgu

SEQ ID NO: 614 - RNA, 27 nt, Artificial Sequence
  Synthetic
ucgguuauggggaugguggauggagac

SEQ ID NO: 615 - RNA, 27 nt, Artificial Sequence
  Synthetic
gucggucauggggaugguggauggaga

SEQ ID NO: 616 - RNA, 27 nt, Artificial Sequence
  Synthetic
agucguucauggggaugguggauggag

SEQ ID NO: 617 - RNA, 27 nt, Artificial Sequence
  Synthetic
cagucugucauggggaugguggaugga

SEQ ID NO: 618 - RNA, 27 nt, Artificial Sequence
  Synthetic
ucaguuggucauggggaugguggaugg

SEQ ID NO: 619 - RNA, 27 nt, Artificial Sequence
  Synthetic
aucagucggucauggggaugguggaug

SEQ ID NO: 620 - RNA, 27 nt, Artificial Sequence
  Synthetic
caucauucggucauggggaugguggau

SEQ ID NO: 621 - RNA, 27 nt, Artificial Sequence
  Synthetic
acaucugucggucauggggauggugga

SEQ ID NO: 622 - RNA, 27 nt, Artificial Sequence
  Synthetic
aacauuagucggucauggggauggugg

SEQ ID NO: 623 - RNA, 27 nt, Artificial Sequence
  Synthetic
gaacaucagucggucauggggauggug

SEQ ID NO: 624 - RNA, 27 nt, Artificial Sequence
  Synthetic
ggaacuucagucggucauggggauggu

SEQ ID NO: 625 - RNA, 27 nt, Artificial Sequence
  Synthetic
gggaauaucagucggucauggggaugg

SEQ ID NO: 626 - RNA, 27 nt, Artificial Sequence
  Synthetic
ugggaucaucagucggucauggggaug

SEQ ID NO: 627 - RNA, 27 nt, Artificial Sequence
  Synthetic
guggguacaucagucggucauggggau

SEQ ID NO: 628 - RNA, 27 nt, Artificial Sequence
  Synthetic
cgugguaacaucagucggucaugggga

SEQ ID NO: 629 - RNA, 27 nt, Artificial Sequence
  Synthetic
ccgugugaacaucagucggucaugggg

SEQ ID NO: 630 - RNA, 27 nt, Artificial Sequence
  Synthetic
auccgugggaacaucagucggucaugg

SEQ ID NO: 631 - RNA, 27 nt, Artificial Sequence
  Synthetic
cauccuugggaacaucagucggucaug

SEQ ID NO: 632 - RNA, 27 nt, Artificial Sequence
  Synthetic
gcaucugugggaacaucagucggucau

SEQ ID NO: 633 - RNA, 27 nt, Artificial Sequence
  Synthetic
agcauucgugggaacaucagucgguca

SEQ ID NO: 634 - RNA, 27 nt, Artificial Sequence
  Synthetic
uagcauccgugggaacaucagucgguc

SEQ ID NO: 635 - RNA, 27 nt, Artificial Sequence
  Synthetic
auuaguauccgugggaacaucagucgg

SEQ ID NO: 636 - RNA, 27 nt, Artificial Sequence
  Synthetic
cauuaucauccgugggaacaucagucg

SEQ ID NO: 637 - RNA, 27 nt, Artificial Sequence
  Synthetic
uucauuagcauccgugggaacaucagu

SEQ ID NO: 638 - RNA, 27 nt, Artificial Sequence
  Synthetic
uuucauuagcauccgugggaacaucag

SEQ ID NO: 639 - RNA, 27 nt, Artificial Sequence
  Synthetic
aguuuuauuagcauccgugggaacauc

SEQ ID NO: 640 - RNA, 27 nt, Artificial Sequence
  Synthetic
caguuucauuagcauccgugggaacau

SEQ ID NO: 641 - RNA, 27 nt, Artificial Sequence
  Synthetic
ccaguuucauuagcauccgugggaaca

SEQ ID NO: 642 - RNA, 27 nt, Artificial Sequence
  Synthetic
accaguuucauuagcauccgugggaac

SEQ ID NO: 643 - RNA, 27 nt, Artificial Sequence
  Synthetic
caccauuuucauuagcauccgugggaa

SEQ ID NO: 644 - RNA, 27 nt, Artificial Sequence
  Synthetic
ucaccuguuucauuagcauccguggga

SEQ ID NO: 645 - RNA, 27 nt, Artificial Sequence
  Synthetic
cucacuaguuucauuagcauccguggg

SEQ ID NO: 646 - RNA, 27 nt, Artificial Sequence
  Synthetic
gcucaucaguuucauuagcauccgugg

SEQ ID NO: 647 - RNA, 27 nt, Artificial Sequence
  Synthetic
ggcucuccaguuucauuagcauccgug

SEQ ID NO: 648 - RNA, 27 nt, Artificial Sequence
  Synthetic
aggcuuaccaguuucauuagcauccgu

SEQ ID NO: 649 - RNA, 27 nt, Artificial Sequence
  Synthetic
gaggcucaccaguuucauuagcauccg

SEQ ID NO: 650 - RNA, 27 nt, Artificial Sequence
  Synthetic
cggagucucaccaguuucauuagcauc

SEQ ID NO: 651 - RNA, 27 nt, Artificial Sequence
  Synthetic
ccggaugcucaccaguuucauuagcau

SEQ ID NO: 652 - RNA, 27 nt, Artificial Sequence
  Synthetic
uccgguggcucaccaguuucauuagca

SEQ ID NO: 653 - RNA, 27 nt, Artificial Sequence
  Synthetic
guccguaggcucaccaguuucauuagc

SEQ ID NO: 654 - RNA, 27 nt, Artificial Sequence
  Synthetic
gguccugaggcucaccaguuucauuag

SEQ ID NO: 655 - RNA, 27 nt, Artificial Sequence
  Synthetic
gggucuggaggcucaccaguuucauua

SEQ ID NO: 656 - RNA, 27 nt, Artificial Sequence
  Synthetic
aggguucggaggcucaccaguuucauu

SEQ ID NO: 657 - RNA, 27 nt, Artificial Sequence
  Synthetic
ucagguuccggaggcucaccaguuuca

SEQ ID NO: 658 - RNA, 27 nt, Artificial Sequence
  Synthetic
cucaguguccggaggcucaccaguuuc

SEQ ID NO: 659 - RNA, 27 nt, Artificial Sequence
  Synthetic
ugcucuggguccggaggcucaccaguu

SEQ ID NO: 660 - RNA, 27 nt, Artificial Sequence
  Synthetic
ugaguugacgcugcucaggguccggag

SEQ ID NO: 661 - RNA, 27 nt, Artificial Sequence
  Synthetic
ucugauuggacgcugcucaggguccgg

SEQ ID NO: 662 - RNA, 27 nt, Artificial Sequence
  Synthetic
cucuguguggacgcugcucaggguccg

SEQ ID NO: 663 - RNA, 27 nt, Artificial Sequence
  Synthetic
gcucuuaguggacgcugcucagggucc

SEQ ID NO: 664 - RNA, 27 nt, Artificial Sequence
  Synthetic
ugcucugaguggacgcugcucaggguc

SEQ ID NO: 665 - RNA, 27 nt, Artificial Sequence
  Synthetic
uugcuuugaguggacgcugcucagggu

SEQ ID NO: 666 - RNA, 27 nt, Artificial Sequence
  Synthetic
cuugcucugaguggacgcugcucaggg

SEQ ID NO: 667 - RNA, 27 nt, Artificial Sequence
  Synthetic
acuuguucugaguggacgcugcucagg

SEQ ID NO: 668 - RNA, 27 nt, Artificial Sequence
  Synthetic
cacuuucucugaguggacgcugcucag

SEQ ID NO: 669 - RNA, 27 nt, Artificial Sequence
  Synthetic
acacuugcucugaguggacgcugcuca

SEQ ID NO: 670 - RNA, 27 nt, Artificial Sequence
  Synthetic
aacacuugcucugaguggacgcugcuc

SEQ ID NO: 671 - RNA, 27 nt, Artificial Sequence
  Synthetic
aaacauuugcucugaguggacgcugcu

SEQ ID NO: 672 - RNA, 27 nt, Artificial Sequence
  Synthetic
caaacucuugcucugaguggacgcugc

SEQ ID NO: 673 - RNA, 27 nt, Artificial Sequence
  Synthetic
gcaaauacuugcucugaguggacgcug

SEQ ID NO: 674 - RNA, 27 nt, Artificial Sequence
  Synthetic
ugcaaucacuugcucugaguggacgcu

SEQ ID NO: 675 - RNA, 27 nt, Artificial Sequence
  Synthetic
gugcauacacuugcucugaguggacgc

SEQ ID NO: 676 - RNA, 27 nt, Artificial Sequence
  Synthetic
agugcuaacacuugcucugaguggacg

SEQ ID NO: 677 - RNA, 27 nt, Artificial Sequence
  Synthetic
caguguaaacacuugcucugaguggac

SEQ ID NO: 678 - RNA, 27 nt, Artificial Sequence
  Synthetic
cgcagugcaaacacuugcucugagugg

SEQ ID NO: 679 - RNA, 27 nt, Artificial Sequence
  Synthetic
acgcauugcaaacacuugcucugagug

SEQ ID NO: 680 - RNA, 27 nt, Artificial Sequence
  Synthetic
gacgcugugcaaacacuugcucugagu

SEQ ID NO: 681 - RNA, 27 nt, Artificial Sequence
  Synthetic
agacguagugcaaacacuugcucugag

SEQ ID NO: 682 - RNA, 27 nt, Artificial Sequence
  Synthetic
cagacucagugcaaacacuugcucuga

SEQ ID NO: 683 - RNA, 27 nt, Artificial Sequence
  Synthetic
gcagaugcagugcaaacacuugcucug

SEQ ID NO: 684 - RNA, 27 nt, Artificial Sequence
  Synthetic
ugcagucgcagugcaaacacuugcucu

SEQ ID NO: 685 - RNA, 27 nt, Artificial Sequence
  Synthetic
cugcauacgcagugcaaacacuugcuc

SEQ ID NO: 686 - RNA, 27 nt, Artificial Sequence
  Synthetic
ccugcugacgcagugcaaacacuugcu

SEQ ID NO: 687 - RNA, 27 nt, Artificial Sequence
  Synthetic
uccuguagacgcagugcaaacacuugc

SEQ ID NO: 688 - RNA, 27 nt, Artificial Sequence
  Synthetic
guccuucagacgcagugcaaacacuug

SEQ ID NO: 689 - RNA, 27 nt, Artificial Sequence
  Synthetic
uguccugcagacgcagugcaaacacuu

SEQ ID NO: 690 - RNA, 27 nt, Artificial Sequence
  Synthetic
uugucuugcagacgcagugcaaacacu

SEQ ID NO: 691 - RNA, 27 nt, Artificial Sequence
  Synthetic
uuuguucugcagacgcagugcaaacac

SEQ ID NO: 692 - RNA, 27 nt, Artificial Sequence
  Synthetic
uuuuguccugcagacgcagugcaaaca

SEQ ID NO: 693 - RNA, 27 nt, Artificial Sequence
  Synthetic
uuuuuuuccugcagacgcagugcaaac

SEQ ID NO: 694 - RNA, 27 nt, Artificial Sequence
  Synthetic
cuuuuuguccugcagacgcagugcaaa

SEQ ID NO: 695 - RNA, 27 nt, Artificial Sequence
  Synthetic
gcuuuuuguccugcagacgcagugcaa

SEQ ID NO: 696 - RNA, 27 nt, Artificial Sequence
  Synthetic
agcuuuuuguccugcagacgcagugca

SEQ ID NO: 697 - RNA, 27 nt, Artificial Sequence
  Synthetic
gagcuuuuuguccugcagacgcagugc

SEQ ID NO: 698 - RNA, 27 nt, Artificial Sequence
  Synthetic
ggagcuuuuuguccugcagacgcagug

SEQ ID NO: 699 - RNA, 27 nt, Artificial Sequence
  Synthetic
gggaguuuuuuguccugcagacgcagu

SEQ ID NO: 700 - RNA, 27 nt, Artificial Sequence
  Synthetic
ugggaucuuuuuguccugcagacgcag

SEQ ID NO: 701 - RNA, 27 nt, Artificial Sequence
  Synthetic
gugggugcuuuuuguccugcagacgca

SEQ ID NO: 702 - RNA, 27 nt, Artificial Sequence
  Synthetic
ggugguagcuuuuuguccugcagacgc

SEQ ID NO: 703 - RNA, 27 nt, Artificial Sequence
  Synthetic
cggugugagcuuuuuguccugcagacg

SEQ ID NO: 704 - RNA, 27 nt, Artificial Sequence
  Synthetic
gcgguuggagcuuuuuguccugcagac

SEQ ID NO: 705 - RNA, 27 nt, Artificial Sequence
  Synthetic
cagcguugggagcuuuuuguccugcag

SEQ ID NO: 706 - RNA, 27 nt, Artificial Sequence
  Synthetic
gcagcugugggagcuuuuuguccugca

SEQ ID NO: 707 - RNA, 27 nt, Artificial Sequence
  Synthetic
agcaguggugggagcuuuuuguccugc

SEQ ID NO: 708 - RNA, 27 nt, Artificial Sequence
  Synthetic
gagcaucggugggagcuuuuuguccug

SEQ ID NO: 709 - RNA, 27 nt, Artificial Sequence
  Synthetic
gagaguagcggugggagcuuuuugucc

SEQ ID NO: 710 - RNA, 27 nt, Artificial Sequence
  Synthetic
agagaucagcggugggagcuuuuuguc

SEQ ID NO: 711 - RNA, 27 nt, Artificial Sequence
  Synthetic
cagagugcagcggugggagcuuuuugu

SEQ ID NO: 712 - RNA, 27 nt, Artificial Sequence
  Synthetic
ucagauagcagcggugggagcuuuuug

SEQ ID NO: 713 - RNA, 27 nt, Artificial Sequence
  Synthetic
cucagugagcagcggugggagcuuuuu

SEQ ID NO: 714 - RNA, 27 nt, Artificial Sequence
  Synthetic
ucucauagagcagcggugggagcuuuu

SEQ ID NO: 715 - RNA, 27 nt, Artificial Sequence
  Synthetic
aucucugagagcagcggugggagcuuu

SEQ ID NO: 716 - RNA, 27 nt, Artificial Sequence
  Synthetic
gaucuuagagagcagcggugggagcuu

SEQ ID NO: 717 - RNA, 27 nt, Artificial Sequence
  Synthetic
cagauuucagagagcagcggugggagc

SEQ ID NO: 718 - RNA, 27 nt, Artificial Sequence
  Synthetic
cccaguucucagagagcagcgguggga

SEQ ID NO: 719 - RNA, 27 nt, Artificial Sequence
  Synthetic
ucccauaucucagagagcagcgguggg

SEQ ID NO: 720 - RNA, 27 nt, Artificial Sequence
  Synthetic
cauccuagaucucagagagcagcggug

SEQ ID NO: 721 - RNA, 27 nt, Artificial Sequence
  Synthetic
acaucucagaucucagagagcagcggu

SEQ ID NO: 722 - RNA, 27 nt, Artificial Sequence
  Synthetic
cacauuccagaucucagagagcagcgg

SEQ ID NO: 723 - RNA, 27 nt, Artificial Sequence
  Synthetic
gugcauaucccagaucucagagagcag

SEQ ID NO: 724 - RNA, 27 nt, Artificial Sequence
  Synthetic
ucguguacaucccagaucucagagagc

SEQ ID NO: 725 - RNA, 27 nt, Artificial Sequence
  Synthetic
uucguucacaucccagaucucagagag

SEQ ID NO: 726 - RNA, 27 nt, Artificial Sequence
  Synthetic
auucgugcacaucccagaucucagaga

SEQ ID NO: 727 - RNA, 27 nt, Artificial Sequence
  Synthetic
cauucuugcacaucccagaucucagag

SEQ ID NO: 728 - RNA, 27 nt, Artificial Sequence
  Synthetic
ucauuugugcacaucccagaucucaga

SEQ ID NO: 729 - RNA, 27 nt, Artificial Sequence
  Synthetic
gucauucgugcacaucccagaucucag

SEQ ID NO: 730 - RNA, 27 nt, Artificial Sequence
  Synthetic
agucauucgugcacaucccagaucuca

SEQ ID NO: 731 - RNA, 27 nt, Artificial Sequence
  Synthetic
cagucuuucgugcacaucccagaucuc

SEQ ID NO: 732 - RNA, 27 nt, Artificial Sequence
  Synthetic
acaguuauucgugcacaucccagaucu

SEQ ID NO: 733 - RNA, 27 nt, Artificial Sequence
  Synthetic
aacagucauucgugcacaucccagauc

SEQ ID NO: 734 - RNA, 27 nt, Artificial Sequence
  Synthetic
gaacauucauucgugcacaucccagau

SEQ ID NO: 735 - RNA, 27 nt, Artificial Sequence
  Synthetic
agaacugucauucgugcacaucccaga

SEQ ID NO: 736 - RNA, 27 nt, Artificial Sequence
  Synthetic
cagaauagucauucgugcacaucccag

SEQ ID NO: 737 - RNA, 27 nt, Artificial Sequence
  Synthetic
acagaucagucauucgugcacauccca

SEQ ID NO: 738 - RNA, 27 nt, Artificial Sequence
  Synthetic
gacaguacagucauucgugcacauccc

SEQ ID NO: 739 - RNA, 27 nt, Artificial Sequence
  Synthetic
uuccauuucuaggaggcagccaccagg

SEQ ID NO: 740 - RNA, 27 nt, Artificial Sequence
  Synthetic
guuccucuucuaggaggcagccaccag

SEQ ID NO: 741 - RNA, 27 nt, Artificial Sequence
  Synthetic
uguucuacuucuaggaggcagccacca

SEQ ID NO: 742 - RNA, 27 nt, Artificial Sequence
  Synthetic
cuguuucacuucuaggaggcagccacc

SEQ ID NO: 743 - RNA, 27 nt, Artificial Sequence
  Synthetic
ucuguuccacuucuaggaggcagccac

SEQ ID NO: 744 - RNA, 27 nt, Artificial Sequence
  Synthetic
gucuguuccacuucuaggaggcagcca

SEQ ID NO: 745 - RNA, 27 nt, Artificial Sequence
  Synthetic
agucuuuuccacuucuaggaggcagcc

SEQ ID NO: 746 - RNA, 27 nt, Artificial Sequence
  Synthetic
cagucuguuccacuucuaggaggcagc

SEQ ID NO: 747 - RNA, 27 nt, Artificial Sequence
  Synthetic
ucaguuuguuccacuucuaggaggcag

SEQ ID NO: 748 - RNA, 27 nt, Artificial Sequence
  Synthetic
cucagucuguuccacuucuaggaggca

SEQ ID NO: 749 - RNA, 27 nt, Artificial Sequence
  Synthetic
ucucauucuguuccacuucuaggaggc

SEQ ID NO: 750 - RNA, 27 nt, Artificial Sequence
  Synthetic
uucucugucuguuccacuucuaggagg

SEQ ID NO: 751 - RNA, 27 nt, Artificial Sequence
  Synthetic
cuucuuagucuguuccacuucuaggag

SEQ ID NO: 752 - RNA, 27 nt, Artificial Sequence
  Synthetic
ccuucucagucuguuccacuucuagga

SEQ ID NO: 753 - RNA, 27 nt, Artificial Sequence
  Synthetic
gcccuucucagucuguuccacuucuag

SEQ ID NO: 754 - RNA, 27 nt, Artificial Sequence
  Synthetic
auguuugcccuucucagucuguuccac

SEQ ID NO: 755 - RNA, 27 nt, Artificial Sequence
  Synthetic
gaauguuugcccuucucagucuguucc

SEQ ID NO: 756 - RNA, 27 nt, Artificial Sequence
  Synthetic
ggaauuuuugcccuucucagucuguuc

SEQ ID NO: 757 - RNA, 27 nt, Artificial Sequence
  Synthetic
aggaauguuugcccuucucagucuguu

SEQ ID NO: 758 - RNA, 27 nt, Artificial Sequence
  Synthetic
caggauuguuugcccuucucagucugu

SEQ ID NO: 759 - RNA, 27 nt, Artificial Sequence
  Synthetic
ccagguauguuugcccuucucagucug

SEQ ID NO: 760 - RNA, 27 nt, Artificial Sequence
  Synthetic
cccaguaauguuugcccuucucagucu

SEQ ID NO: 761 - RNA, 27 nt, Artificial Sequence
  Synthetic
ucccaugaauguuugcccuucucaguc

SEQ ID NO: 762 - RNA, 27 nt, Artificial Sequence
  Synthetic
cucccuggaauguuugcccuucucagu

SEQ ID NO: 763 - RNA, 27 nt, Artificial Sequence
  Synthetic
gcuccuaggaauguuugcccuucucag

SEQ ID NO: 764 - RNA, 27 nt, Artificial Sequence
  Synthetic
uuugauucucuuuuaaugccacgggag

SEQ ID NO: 765 - RNA, 27 nt, Artificial Sequence
  Synthetic
cuuugucucucuuuuaaugccacggga

SEQ ID NO: 766 - RNA, 27 nt, Artificial Sequence
  Synthetic
ccuuuuacucucuuuuaaugccacggg

SEQ ID NO: 767 - RNA, 27 nt, Artificial Sequence
  Synthetic
cccuuugacucucuuuuaaugccacgg

SEQ ID NO: 768 - RNA, 27 nt, Artificial Sequence
  Synthetic
acccuuugacucucuuuuaaugccacg

SEQ ID NO: 769 - RNA, 36 nt, Artificial Sequence
  Synthetic
guguccugucagaagaacaagcagccgaaaggcugc

SEQ ID NO: 770 - RNA, 36 nt, Artificial Sequence
  Synthetic
guccugucagaagaacagaagcagccgaaaggcugc

SEQ ID NO: 771 - RNA, 36 nt, Artificial Sequence
  Synthetic
ccugucagaagaacagaucagcagccgaaaggcugc

SEQ ID NO: 772 - RNA, 36 nt, Artificial Sequence
  Synthetic
cugucagaagaacagauccagcagccgaaaggcugc

SEQ ID NO: 773 - RNA, 36 nt, Artificial Sequence
  Synthetic
ugucagaagaacagauccgagcagccgaaaggcugc

SEQ ID NO: 774 - RNA, 36 nt, Artificial Sequence
  Synthetic
gaaacugaagcggcaagagagcagccgaaaggcugc

SEQ ID NO: 775 - RNA, 36 nt, Artificial Sequence
  Synthetic
gugaugcuucuggagacauagcagccgaaaggcugc

SEQ ID NO: 776 - RNA, 36 nt, Artificial Sequence
  Synthetic
ggagugagaguaucaccuuagcagccgaaaggcugc

SEQ ID NO: 777 - RNA, 36 nt, Artificial Sequence
  Synthetic
agaguaucaccuuccucaaagcagccgaaaggcugc

SEQ ID NO: 778 - RNA, 36 nt, Artificial Sequence
  Synthetic
aucaccuuccucaaggauuagcagccgaaaggcugc

SEQ ID NO: 779 - RNA, 36 nt, Artificial Sequence
  Synthetic
ucaccuuccucaaggauuuagcagccgaaaggcugc

SEQ ID NO: 780 - RNA, 36 nt, Artificial Sequence
  Synthetic
caccuuccucaaggauuucagcagccgaaaggcugc

SEQ ID NO: 781 - RNA, 36 nt, Artificial Sequence
  Synthetic
accuuccucaaggauuucaagcagccgaaaggcugc

SEQ ID NO: 782 - RNA, 36 nt, Artificial Sequence
  Synthetic
ccuuccucaaggauuucagagcagccgaaaggcugc

SEQ ID NO: 783 - RNA, 36 nt, Artificial Sequence
  Synthetic
cuuccucaaggauuucaguagcagccgaaaggcugc

SEQ ID NO: 784 - RNA, 36 nt, Artificial Sequence
  Synthetic
uuccucaaggauuucaguuagcagccgaaaggcugc

SEQ ID NO: 785 - RNA, 36 nt, Artificial Sequence
  Synthetic
ccucaaggauuucaguuauagcagccgaaaggcugc

SEQ ID NO: 786 - RNA, 36 nt, Artificial Sequence
  Synthetic
cucaaggauuucaguuauaagcagccgaaaggcugc

SEQ ID NO: 787 - RNA, 36 nt, Artificial Sequence
  Synthetic
ucaaggauuucaguuauaaagcagccgaaaggcugc

SEQ ID NO: 788 - RNA, 36 nt, Artificial Sequence
  Synthetic
caaggauuucaguuauaacagcagccgaaaggcugc

SEQ ID NO: 789 - RNA, 36 nt, Artificial Sequence
  Synthetic
aaggauuucaguuauaaccagcagccgaaaggcugc

SEQ ID NO: 790 - RNA, 36 nt, Artificial Sequence
  Synthetic
aggauuucaguuauaaccgagcagccgaaaggcugc

SEQ ID NO: 791 - RNA, 36 nt, Artificial Sequence
  Synthetic
ggauuucaguuauaaccggagcagccgaaaggcugc

SEQ ID NO: 792 - RNA, 36 nt, Artificial Sequence
  Synthetic
aguuauaaccgggaagacuagcagccgaaaggcugc

SEQ ID NO: 793 - RNA, 36 nt, Artificial Sequence
  Synthetic
cagggcugcaaguggaauuagcagccgaaaggcugc

SEQ ID NO: 794 - RNA, 36 nt, Artificial Sequence
  Synthetic
cugcaaguggaauucaucaagcagccgaaaggcugc

SEQ ID NO: 795 - RNA, 36 nt, Artificial Sequence
  Synthetic
ugcaaguggaauucaucaaagcagccgaaaggcugc

SEQ ID NO: 796 - RNA, 36 nt, Artificial Sequence
  Synthetic
gcaaguggaauucaucaacagcagccgaaaggcugc

SEQ ID NO: 797 - RNA, 36 nt, Artificial Sequence
  Synthetic
caaguggaauucaucaaccagcagccgaaaggcugc

SEQ ID NO: 798 - RNA, 36 nt, Artificial Sequence
  Synthetic
guggaauucaucaaccccaagcagccgaaaggcugc

SEQ ID NO: 799 - RNA, 36 nt, Artificial Sequence
  Synthetic
uggaauucaucaaccccauagcagccgaaaggcugc

SEQ ID NO: 800 - RNA, 36 nt, Artificial Sequence
  Synthetic
gaauucaucaaccccaucuagcagccgaaaggcugc

SEQ ID NO: 801 - RNA, 36 nt, Artificial Sequence
  Synthetic
aauucaucaaccccaucuuagcagccgaaaggcugc

SEQ ID NO: 802 - RNA, 36 nt, Artificial Sequence
  Synthetic
ugcagcacacauauguggaagcagccgaaaggcugc

SEQ ID NO: 803 - RNA, 36 nt, Artificial Sequence
  Synthetic
gcacacauauguggaagccagcagccgaaaggcugc

SEQ ID NO: 804 - RNA, 36 nt, Artificial Sequence
  Synthetic
caugaccgacugauguuccagcagccgaaaggcugc

SEQ ID NO: 805 - RNA, 36 nt, Artificial Sequence
  Synthetic
cgacugauguucccacggaagcagccgaaaggcugc

SEQ ID NO: 806 - RNA, 36 nt, Artificial Sequence
  Synthetic
gacugauguucccacggauagcagccgaaaggcugc

SEQ ID NO: 807 - RNA, 36 nt, Artificial Sequence
  Synthetic
cugauguucccacggaugcagcagccgaaaggcugc

SEQ ID NO: 808 - RNA, 36 nt, Artificial Sequence
  Synthetic
gauguucccacggaugcuaagcagccgaaaggcugc

SEQ ID NO: 809 - RNA, 36 nt, Artificial Sequence
  Synthetic
auguucccacggaugcuaaagcagccgaaaggcugc

SEQ ID NO: 810 - RNA, 36 nt, Artificial Sequence
  Synthetic
ggaugcuaaugaaacugguagcagccgaaaggcugc

SEQ ID NO: 811 - RNA, 36 nt, Artificial Sequence
  Synthetic
augcuaaugaaacuggugaagcagccgaaaggcugc

SEQ ID NO: 812 - RNA, 36 nt, Artificial Sequence
  Synthetic
cacucagagcaaguguuugagcagccgaaaggcugc

SEQ ID NO: 813 - RNA, 36 nt, Artificial Sequence
  Synthetic
augugcacgaaugacuguuagcagccgaaaggcugc

SEQ ID NO: 814 - RNA, 36 nt, Artificial Sequence
  Synthetic
ugugcacgaaugacuguucagcagccgaaaggcugc

SEQ ID NO: 815 - RNA, 36 nt, Artificial Sequence
  Synthetic
gugcacgaaugacuguucuagcagccgaaaggcugc

SEQ ID NO: 816 - RNA, 36 nt, Artificial Sequence
  Synthetic
uagaaguggaacagacugaagcagccgaaaggcugc

SEQ ID NO: 817 - RNA, 36 nt, Artificial Sequence
  Synthetic
gaaguggaacagacugagaagcagccgaaaggcugc

SEQ ID NO: 818 - RNA, 36 nt, Artificial Sequence
  Synthetic
aaguggaacagacugagaaagcagccgaaaggcugc

SEQ ID NO: 819 - RNA, 36 nt, Artificial Sequence
  Synthetic
aguggaacagacugagaagagcagccgaaaggcugc

SEQ ID NO: 820 - RNA, 36 nt, Artificial Sequence
  Synthetic
guggaacagacugagaaggagcagccgaaaggcugc

SEQ ID NO: 821 - RNA, 36 nt, Artificial Sequence
  Synthetic
uggaacagacugagaagggagcagccgaaaggcugc

SEQ ID NO: 822 - RNA, 36 nt, Artificial Sequence
  Synthetic
gaacagacugagaagggcaagcagccgaaaggcugc

SEQ ID NO: 823 - RNA, 33 nt, Artificial Sequence
  Synthetic
uccucaaggauuucaguuaagcagccgggcugc

SEQ ID NO: 824 - RNA, 33 nt, Artificial Sequence
  Synthetic
caguuauaaccgggaagacagcagccgggcugc

SEQ ID NO: 825 - RNA, 33 nt, Artificial Sequence
  Synthetic
uauaaccgggaagacuuugagcagccgggcugc

SEQ ID NO: 826 - RNA, 33 nt, Artificial Sequence
  Synthetic
caaagcagggcugcaagugagcagccgggcugc

SEQ ID NO: 827 - RNA, 33 nt, Artificial Sequence
  Synthetic
ggcugcaaguggaauucauagcagccgggcugc

SEQ ID NO: 828 - RNA, 33 nt, Artificial Sequence
  Synthetic
aguggaauucaucaaccccagcagccgggcugc

SEQ ID NO: 829 - RNA, 33 nt, Artificial Sequence
  Synthetic
auucaucaaccccaucuucagcagccgggcugc

SEQ ID NO: 830 - RNA, 33 nt, Artificial Sequence
  Synthetic
uucaucaaccccaucuucgagcagccgggcugc

SEQ ID NO: 831 - RNA, 33 nt, Artificial Sequence
  Synthetic
ugcaugccuacgucuccauagcagccgggcugc

SEQ ID NO: 832 - RNA, 33 nt, Artificial Sequence
  Synthetic
ugccuacgucuccauccacagcagccgggcugc

SEQ ID NO: 833 - RNA, 33 nt, Artificial Sequence
  Synthetic
uacgucuccauccaccaucagcagccgggcugc

SEQ ID NO: 834 - RNA, 33 nt, Artificial Sequence
  Synthetic
cgucuccauccaccaucccagcagccgggcugc

SEQ ID NO: 835 - RNA, 33 nt, Artificial Sequence
  Synthetic
auccaccauccccaugaccagcagccgggcugc

SEQ ID NO: 836 - RNA, 33 nt, Artificial Sequence
  Synthetic
ccgacugauguucccacggagcagccgggcugc

SEQ ID NO: 837 - RNA, 33 nt, Artificial Sequence
  Synthetic
cccacggaugcuaaugaaaagcagccgggcugc

SEQ ID NO: 838 - RNA, 33 nt, Artificial Sequence
  Synthetic
cggaugcuaaugaaacuggagcagccgggcugc

SEQ ID NO: 839 - RNA, 33 nt, Artificial Sequence
  Synthetic
gaugcuaaugaaacuggugagcagccgggcugc

SEQ ID NO: 840 - RNA, 33 nt, Artificial Sequence
  Synthetic
cuaaugaaacuggugagccagcagccgggcugc

SEQ ID NO: 841 - RNA, 33 nt, Artificial Sequence
  Synthetic
agcagcguccacucagagcagcagccgggcugc

SEQ ID NO: 842 - RNA, 33 nt, Artificial Sequence
  Synthetic
cagcguccacucagagcaaagcagccgggcugc

SEQ ID NO: 843 - RNA, 33 nt, Artificial Sequence
  Synthetic
agcguccacucagagcaagagcagccgggcugc

SEQ ID NO: 844 - RNA, 33 nt, Artificial Sequence
  Synthetic
caaguguuugcacugcgucagcagccgggcugc

SEQ ID NO: 845 - RNA, 33 nt, Artificial Sequence
  Synthetic
aguguuugcacugcgucugagcagccgggcugc

SEQ ID NO: 846 - RNA, 33 nt, Artificial Sequence
  Synthetic
cugcgucugcaggacaaaaagcagccgggcugc

SEQ ID NO: 847 - RNA, 33 nt, Artificial Sequence
  Synthetic
caggacaaaaagcucccacagcagccgggcugc

SEQ ID NO: 848 - RNA, 33 nt, Artificial Sequence
  Synthetic
ucugagaucugggaugugcagcagccgggcugc

SEQ ID NO: 849 - RNA, 33 nt, Artificial Sequence
  Synthetic
gaucugggaugugcacgaaagcagccgggcugc

SEQ ID NO: 850 - RNA, 33 nt, Artificial Sequence
  Synthetic
aucugggaugugcacgaauagcagccgggcugc

SEQ ID NO: 851 - RNA, 33 nt, Artificial Sequence
  Synthetic
ucugggaugugcacgaaugagcagccgggcugc

SEQ ID NO: 852 - RNA, 33 nt, Artificial Sequence
  Synthetic
ugccuccuagaaguggaacagcagccgggcugc

SEQ ID NO: 853 - RNA, 33 nt, Artificial Sequence
  Synthetic
agaaguggaacagacugagagcagccgggcugc

SEQ ID NO: 854 - RNA, 33 nt, Artificial Sequence
  Synthetic
acugagaagggcaaacauuagcagccgggcugc

SEQ ID NO: 855 - RNA, 33 nt, Artificial Sequence
  Synthetic
guggcauuaaaagagagucagcagccgggcugc

SEQ ID NO: 856 - RNA, 33 nt, Artificial Sequence
  Synthetic
uggcauuaaaagagagucaagcagccgggcugc

SEQ ID NO: 857 - RNA, 22 nt, Artificial Sequence
  Synthetic
uuguucuucugacaggacacgg

SEQ ID NO: 858 - RNA, 22 nt, Artificial Sequence
  Synthetic
uucuguucuucugacaggacgg

SEQ ID NO: 859 - RNA, 22 nt, Artificial Sequence
  Synthetic
ugaucuguucuucugacagggg

SEQ ID NO: 860 - RNA, 22 nt, Artificial Sequence
  Synthetic
uggaucuguucuucugacaggg

SEQ ID NO: 861 - RNA, 22 nt, Artificial Sequence
  Synthetic
ucggaucuguucuucugacagg

SEQ ID NO: 862 - RNA, 22 nt, Artificial Sequence
  Synthetic
ucucuugccgcuucaguuucgg

SEQ ID NO: 863 - RNA, 22 nt, Artificial Sequence
  Synthetic
uaugucuccagaagcaucacgg

SEQ ID NO: 864 - RNA, 22 nt, Artificial Sequence
  Synthetic
uaaggugauacucucacuccgg

SEQ ID NO: 865 - RNA, 22 nt, Artificial Sequence
  Synthetic
uuugaggaaggugauacucugg

SEQ ID NO: 866 - RNA, 22 nt, Artificial Sequence
  Synthetic
uaauccuugaggaaggugaugg

SEQ ID NO: 867 - RNA, 22 nt, Artificial Sequence
  Synthetic
uaaauccuugaggaaggugagg

SEQ ID NO: 868 - RNA, 22 nt, Artificial Sequence
  Synthetic
ugaaauccuugaggaagguggg

SEQ ID NO: 869 - RNA, 22 nt, Artificial Sequence
  Synthetic
uugaaauccuugaggaaggugg

SEQ ID NO: 870 - RNA, 22 nt, Artificial Sequence
  Synthetic
ucugaaauccuugaggaagggg

SEQ ID NO: 871 - RNA, 22 nt, Artificial Sequence
  Synthetic
uacugaaauccuugaggaaggg

SEQ ID NO: 872 - RNA, 22 nt, Artificial Sequence
  Synthetic
uaacugaaauccuugaggaagg

SEQ ID NO: 873 - RNA, 22 nt, Artificial Sequence
  Synthetic
uauaacugaaauccuugagggg

SEQ ID NO: 874 - RNA, 22 nt, Artificial Sequence
  Synthetic
uuauaacugaaauccuugaggg

SEQ ID NO: 875 - RNA, 22 nt, Artificial Sequence
  Synthetic
uuuauaacugaaauccuugagg

SEQ ID NO: 876 - RNA, 22 nt, Artificial Sequence
  Synthetic
uguuauaacugaaauccuuggg

SEQ ID NO: 877 - RNA, 22 nt, Artificial Sequence
  Synthetic
ugguuauaacugaaauccuugg

SEQ ID NO: 878 - RNA, 22 nt, Artificial Sequence
  Synthetic
ucgguuauaacugaaauccugg

SEQ ID NO: 879 - RNA, 22 nt, Artificial Sequence
  Synthetic
uccgguuauaacugaaauccgg

SEQ ID NO: 880 - RNA, 22 nt, Artificial Sequence
  Synthetic
uagucuucccgguuauaacugg

SEQ ID NO: 881 - RNA, 22 nt, Artificial Sequence
  Synthetic
uaauuccacuugcagcccuggg

SEQ ID NO: 882 - RNA, 22 nt, Artificial Sequence
  Synthetic
uugaugaauuccacuugcaggg

SEQ ID NO: 883 - RNA, 22 nt, Artificial Sequence
  Synthetic
uuugaugaauuccacuugcagg

SEQ ID NO: 884 - RNA, 22 nt, Artificial Sequence
  Synthetic
uguugaugaauuccacuugcgg

SEQ ID NO: 885 - RNA, 22 nt, Artificial Sequence
  Synthetic
ugguugaugaauuccacuuggg

SEQ ID NO: 886 - RNA, 22 nt, Artificial Sequence
  Synthetic
uugggguugaugaauuccacgg

SEQ ID NO: 887 - RNA, 22 nt, Artificial Sequence
  Synthetic
uaugggguugaugaauuccagg

SEQ ID NO: 888 - RNA, 22 nt, Artificial Sequence
  Synthetic
uagaugggguugaugaauucgg

SEQ ID NO: 889 - RNA, 22 nt, Artificial Sequence
  Synthetic
uaagaugggguugaugaauugg

SEQ ID NO: 890 - RNA, 22 nt, Artificial Sequence
  Synthetic
uuccacauaugugugcugcagg

SEQ ID NO: 891 - RNA, 22 nt, Artificial Sequence
  Synthetic
uggcuuccacauaugugugcgg

SEQ ID NO: 892 - RNA, 22 nt, Artificial Sequence
  Synthetic
uggaacaucagucggucauggg

SEQ ID NO: 893 - RNA, 22 nt, Artificial Sequence
  Synthetic
uuccgugggaacaucagucggg

SEQ ID NO: 894 - RNA, 22 nt, Artificial Sequence
  Synthetic
uauccgugggaacaucagucgg

SEQ ID NO: 895 - RNA, 22 nt, Artificial Sequence
  Synthetic
ugcauccgugggaacaucaggg

SEQ ID NO: 896 - RNA, 22 nt, Artificial Sequence
  Synthetic
uuagcauccgugggaacaucgg

SEQ ID NO: 897 - RNA, 22 nt, Artificial Sequence
  Synthetic
uuuagcauccgugggaacaugg

SEQ ID NO: 898 - RNA, 22 nt, Artificial Sequence
  Synthetic
uaccaguuucauuagcauccgg

SEQ ID NO: 899 - RNA, 22 nt, Artificial Sequence
  Synthetic
uucaccaguuucauuagcaugg

SEQ ID NO: 900 - RNA, 22 nt, Artificial Sequence
  Synthetic
ucaaacacuugcucugaguggg

SEQ ID NO: 901 - RNA, 22 nt, Artificial Sequence
  Synthetic
uaacagucauucgugcacaugg

SEQ ID NO: 902 - RNA, 22 nt, Artificial Sequence
  Synthetic
ugaacagucauucgugcacagg

SEQ ID NO: 903 - RNA, 22 nt, Artificial Sequence
  Synthetic
uagaacagucauucgugcacgg

SEQ ID NO: 904 - RNA, 22 nt, Artificial Sequence
  Synthetic
uucagucuguuccacuucuagg

SEQ ID NO: 905 - RNA, 22 nt, Artificial Sequence
  Synthetic
uucucagucuguuccacuucgg

SEQ ID NO: 906 - RNA, 22 nt, Artificial Sequence
  Synthetic
uuucucagucuguuccacuugg

SEQ ID NO: 907 - RNA, 22 nt, Artificial Sequence
  Synthetic
ucuucucagucuguuccacugg

SEQ ID NO: 908 - RNA, 22 nt, Artificial Sequence
  Synthetic
uccuucucagucuguuccacgg

SEQ ID NO: 909 - RNA, 22 nt, Artificial Sequence
  Synthetic
ucccuucucagucuguuccagg

SEQ ID NO: 910 - RNA, 22 nt, Artificial Sequence
  Synthetic
uugcccuucucagucuguucgg

SEQ ID NO: 911 - RNA, 22 nt, Artificial Sequence
  Synthetic
uuaacugaaauccuugaggagg

SEQ ID NO: 912 - RNA, 22 nt, Artificial Sequence
  Synthetic
ugucuucccgguuauaacuggg

SEQ ID NO: 913 - RNA, 22 nt, Artificial Sequence
  Synthetic
ucaaagucuucccgguuauagg

SEQ ID NO: 914 - RNA, 22 nt, Artificial Sequence
  Synthetic
ucacuugcagcccugcuuuggg

SEQ ID NO: 915 - RNA, 22 nt, Artificial Sequence
  Synthetic
uaugaauuccacuugcagccgg

SEQ ID NO: 916 - RNA, 22 nt, Artificial Sequence
  Synthetic
ugggguugaugaauuccacugg

SEQ ID NO: 917 - RNA, 22 nt, Artificial Sequence
  Synthetic
ugaagaugggguugaugaaugg

SEQ ID NO: 918 - RNA, 22 nt, Artificial Sequence
  Synthetic
ucgaagaugggguugaugaagg

SEQ ID NO: 919 - RNA, 22 nt, Artificial Sequence
  Synthetic
uauggagacguaggcaugcagg

SEQ ID NO: 920 - RNA, 22 nt, Artificial Sequence
  Synthetic
uguggauggagacguaggcagg

SEQ ID NO: 921 - RNA, 22 nt, Artificial Sequence
  Synthetic
ugaugguggauggagacguagg

SEQ ID NO: 922 - RNA, 22 nt, Artificial Sequence
  Synthetic
ugggaugguggauggagacggg

SEQ ID NO: 923 - RNA, 22 nt, Artificial Sequence
  Synthetic
uggucauggggaugguggaugg

SEQ ID NO: 924 - RNA, 22 nt, Artificial Sequence
  Synthetic
uccgugggaacaucagucgggg

SEQ ID NO: 925 - RNA, 22 nt, Artificial Sequence
  Synthetic
uuuucauuagcauccguggggg

SEQ ID NO: 926 - RNA, 22 nt, Artificial Sequence
  Synthetic
uccaguuucauuagcauccggg

SEQ ID NO: 927 - RNA, 22 nt, Artificial Sequence
  Synthetic
ucaccaguuucauuagcaucgg

SEQ ID NO: 928 - RNA, 22 nt, Artificial Sequence
  Synthetic
uggcucaccaguuucauuaggg

SEQ ID NO: 929 - RNA, 22 nt, Artificial Sequence
  Synthetic
ugcucugaguggacgcugcugg

SEQ ID NO: 930 - RNA, 22 nt, Artificial Sequence
  Synthetic
uuugcucugaguggacgcuggg

SEQ ID NO: 931 - RNA, 22 nt, Artificial Sequence
  Synthetic
ucuugcucugaguggacgcugg

SEQ ID NO: 932 - RNA, 22 nt, Artificial Sequence
  Synthetic
ugacgcagugcaaacacuuggg

SEQ ID NO: 933 - RNA, 22 nt, Artificial Sequence
  Synthetic
ucagacgcagugcaaacacugg

SEQ ID NO: 934 - RNA, 22 nt, Artificial Sequence
  Synthetic
uuuuuguccugcagacgcaggg

SEQ ID NO: 935 - RNA, 22 nt, Artificial Sequence
  Synthetic
ugugggagcuuuuuguccuggg

SEQ ID NO: 936 - RNA, 22 nt, Artificial Sequence
  Synthetic
ugcacaucccagaucucagagg

SEQ ID NO: 937 - RNA, 22 nt, Artificial Sequence
  Synthetic
uuucgugcacaucccagaucgg

SEQ ID NO: 938 - RNA, 22 nt, Artificial Sequence
  Synthetic
uauucgugcacaucccagaugg

SEQ ID NO: 939 - RNA, 22 nt, Artificial Sequence
  Synthetic
ucauucgugcacaucccagagg

SEQ ID NO: 940 - RNA, 22 nt, Artificial Sequence
  Synthetic
uguuccacuucuaggaggcagg

SEQ ID NO: 941 - RNA, 22 nt, Artificial Sequence
  Synthetic
ucucagucuguuccacuucugg

SEQ ID NO: 942 - RNA, 22 nt, Artificial Sequence
  Synthetic
uaauguuugcccuucucagugg

SEQ ID NO: 943 - RNA, 22 nt, Artificial Sequence
  Synthetic
ugacucucuuuuaaugccacgg

SEQ ID NO: 944 - RNA, 22 nt, Artificial Sequence
  Synthetic
uugacucucuuuuaaugccagg

SEQ ID NO: 945 - RNA, 36 nt, Artificial Sequence; identical to SEQ ID NO: 769
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 946 - RNA, 36 nt, Artificial Sequence; identical to SEQ ID NO: 770
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 947 - RNA, 36 nt, Artificial Sequence; identical to SEQ ID NO: 771
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 948 - RNA, 36 nt, Artificial Sequence; identical to SEQ ID NO: 772
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 949 - RNA, 36 nt, Artificial Sequence; identical to SEQ ID NO: 773
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 950 - RNA, 36 nt, Artificial Sequence; identical to SEQ ID NO: 774
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 951 - RNA, 36 nt, Artificial Sequence; identical to SEQ ID NO: 775
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 952 - RNA, 36 nt, Artificial Sequence; identical to SEQ ID NO: 776
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 953 - RNA, 36 nt, Artificial Sequence; identical to SEQ ID NO: 777
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 954 - RNA, 36 nt, Artificial Sequence; identical to SEQ ID NO: 778
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 955 - RNA, 36 nt, Artificial Sequence; identical to SEQ ID NO: 779
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 956 - RNA, 36 nt, Artificial Sequence; identical to SEQ ID NO: 780
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 957 - RNA, 36 nt, Artificial Sequence; identical to SEQ ID NO: 781
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 958 - RNA, 36 nt, Artificial Sequence; identical to SEQ ID NO: 782
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 959 - RNA, 36 nt, Artificial Sequence; identical to SEQ ID NO: 783
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 960 - RNA, 36 nt, Artificial Sequence; identical to SEQ ID NO: 784
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 961 - RNA, 36 nt, Artificial Sequence
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified
uccucaaggauuucaguuaagcagccgaaaggcugc

SEQ ID NO: 962 - RNA, 36 nt, Artificial Sequence; identical to SEQ ID NO: 785
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 963 - RNA, 36 nt, Artificial Sequence; identical to SEQ ID NO: 786
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 964 - RNA, 36 nt, Artificial Sequence; identical to SEQ ID NO: 787
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 965 - RNA, 36 nt, Artificial Sequence; identical to SEQ ID NO: 788
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 966 - RNA, 36 nt, Artificial Sequence; identical to SEQ ID NO: 789
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 967 - RNA, 36 nt, Artificial Sequence; identical to SEQ ID NO: 790
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 968 - RNA, 36 nt, Artificial Sequence; identical to SEQ ID NO: 791
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 969 - RNA, 36 nt, Artificial Sequence
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified
caguuauaaccgggaagacagcagccgaaaggcugc

SEQ ID NO: 970 - RNA, 36 nt, Artificial Sequence; identical to SEQ ID NO: 792
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 971 - RNA, 36 nt, Artificial Sequence
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified
uauaaccgggaagacuuugagcagccgaaaggcugc

SEQ ID NO: 972 - RNA, 36 nt, Artificial Sequence
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified
caaagcagggcugcaagugagcagccgaaaggcugc

SEQ ID NO: 973 - RNA, 36 nt, Artificial Sequence; identical to SEQ ID NO: 793
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 974 - RNA, 36 nt, Artificial Sequence
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified
ggcugcaaguggaauucauagcagccgaaaggcugc

SEQ ID NO: 975 - RNA, 36 nt, Artificial Sequence; identical to SEQ ID NO: 794
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 976 - RNA, 36 nt, Artificial Sequence; identical to SEQ ID NO: 795
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 977 - RNA, 36 nt, Artificial Sequence; identical to SEQ ID NO: 796
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 978 - RNA, 36 nt, Artificial Sequence; identical to SEQ ID NO: 797
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 979 - RNA, 36 nt, Artificial Sequence
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified
aguggaauucaucaaccccagcagccgaaaggcugc

SEQ ID NO: 980 - RNA, 36 nt, Artificial Sequence; identical to SEQ ID NO: 798
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 981 - RNA, 36 nt, Artificial Sequence; identical to SEQ ID NO: 799
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 982 - RNA, 36 nt, Artificial Sequence; identical to SEQ ID NO: 800
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 983 - RNA, 36 nt, Artificial Sequence; identical to SEQ ID NO: 801
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 984 - RNA, 36 nt, Artificial Sequence
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified
auucaucaaccccaucuucagcagccgaaaggcugc

SEQ ID NO: 985 - RNA, 36 nt, Artificial Sequence
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified
uucaucaaccccaucuucgagcagccgaaaggcugc

SEQ ID NO: 986 - RNA, 36 nt, Artificial Sequence; identical to SEQ ID NO: 802
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 987 - RNA, 36 nt, Artificial Sequence; identical to SEQ ID NO: 803
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 988 - RNA, 36 nt, Artificial Sequence
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified
ugcaugccuacgucuccauagcagccgaaaggcugc

SEQ ID NO: 989 - RNA, 36 nt, Artificial Sequence
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified
ugccuacgucuccauccacagcagccgaaaggcugc

SEQ ID NO: 990 - RNA, 36 nt, Artificial Sequence
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified
uacgucuccauccaccaucagcagccgaaaggcugc

SEQ ID NO: 991 - RNA, 36 nt, Artificial Sequence
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified
cgucuccauccaccaucccagcagccgaaaggcugc

SEQ ID NO: 992 - RNA, 36 nt, Artificial Sequence
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified
auccaccauccccaugaccagcagccgaaaggcugc

SEQ ID NO: 993 - RNA, 36 nt, Artificial Sequence; identical to SEQ ID NO: 804
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 994 - RNA, 36 nt, Artificial Sequence
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified
ccgacugauguucccacggagcagccgaaaggcugc

SEQ ID NO: 995 - RNA, 36 nt, Artificial Sequence; identical to SEQ ID NO: 805
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 996 - RNA, 36 nt, Artificial Sequence; identical to SEQ ID NO: 806
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 997 - RNA, 36 nt, Artificial Sequence; identical to SEQ ID NO: 807
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 998 - RNA, 36 nt, Artificial Sequence; identical to SEQ ID NO: 808
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 999 - RNA, 36 nt, Artificial Sequence; identical to SEQ ID NO: 809
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 1000 - RNA, 36 nt, Artificial Sequence
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified
cccacggaugcuaaugaaaagcagccgaaaggcugc

SEQ ID NO: 1001 - RNA, 36 nt, Artificial Sequence
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified
cggaugcuaaugaaacuggagcagccgaaaggcugc

SEQ ID NO: 1002 - RNA, 36 nt, Artificial Sequence; identical to SEQ ID NO: 810
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 1003 - RNA, 36 nt, Artificial Sequence
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified
gaugcuaaugaaacuggugagcagccgaaaggcugc

SEQ ID NO: 1004 - RNA, 36 nt, Artificial Sequence; identical to SEQ ID NO: 811
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 1005 - RNA, 36 nt, Artificial Sequence
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified
cuaaugaaacuggugagccagcagccgaaaggcugc

SEQ ID NO: 1006 - RNA, 36 nt, Artificial Sequence
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified
agcagcguccacucagagcagcagccgaaaggcugc

SEQ ID NO: 1007 - RNA, 36 nt, Artificial Sequence
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified
cagcguccacucagagcaaagcagccgaaaggcugc

SEQ ID NO: 1008 - RNA, 36 nt, Artificial Sequence
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified
agcguccacucagagcaagagcagccgaaaggcugc

SEQ ID NO: 1009 - RNA, 36 nt, Artificial Sequence; identical to SEQ ID NO: 812
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 1010 - RNA, 36 nt, Artificial Sequence
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified
caaguguuugcacugcgucagcagccgaaaggcugc

SEQ ID NO: 1011 - RNA, 36 nt, Artificial Sequence
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified
aguguuugcacugcgucugagcagccgaaaggcugc

SEQ ID NO: 1012 - RNA, 36 nt, Artificial Sequence
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified
cugcgucugcaggacaaaaagcagccgaaaggcugc

SEQ ID NO: 1013 - RNA, 36 nt, Artificial Sequence
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified
caggacaaaaagcucccacagcagccgaaaggcugc

SEQ ID NO: 1014 - RNA, 36 nt, Artificial Sequence
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified
ucugagaucugggaugugcagcagccgaaaggcugc

SEQ ID NO: 1015 - RNA, 36 nt, Artificial Sequence
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified
gaucugggaugugcacgaaagcagccgaaaggcugc

SEQ ID NO: 1016 - RNA, 36 nt, Artificial Sequence
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified
aucugggaugugcacgaauagcagccgaaaggcugc

SEQ ID NO: 1017 - RNA, 36 nt, Artificial Sequence
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified
ucugggaugugcacgaaugagcagccgaaaggcugc

SEQ ID NO: 1018 - RNA, 36 nt, Artificial Sequence; identical to SEQ ID NO: 813
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 1019 - RNA, 36 nt, Artificial Sequence; identical to SEQ ID NO: 814
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 1020 - RNA, 36 nt, Artificial Sequence; identical to SEQ ID NO: 815
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 1021 - RNA, 36 nt, Artificial Sequence
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified
ugccuccuagaaguggaacagcagccgaaaggcugc

SEQ ID NO: 1022 - RNA, 36 nt, Artificial Sequence; identical to SEQ ID NO: 816
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 1023 - RNA, 36 nt, Artificial Sequence
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified
agaaguggaacagacugagagcagccgaaaggcugc

SEQ ID NO: 1024 - RNA, 36 nt, Artificial Sequence; identical to SEQ ID NO: 817
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 1025 - RNA, 36 nt, Artificial Sequence; identical to SEQ ID NO: 818
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 1026 - RNA, 36 nt, Artificial Sequence; identical to SEQ ID NO: 819
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 1027 - RNA, 36 nt, Artificial Sequence; identical to SEQ ID NO: 820
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 1028 - RNA, 36 nt, Artificial Sequence; identical to SEQ ID NO: 821
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 1029 - RNA, 36 nt, Artificial Sequence; identical to SEQ ID NO: 822
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified

SEQ ID NO: 1030 - RNA, 36 nt, Artificial Sequence
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified
acugagaagggcaaacauuagcagccgaaaggcugc

SEQ ID NO: 1031 - RNA, 36 nt, Artificial Sequence
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified
guggcauuaaaagagagucagcagccgaaaggcugc

SEQ ID NO: 1032 - RNA, 36 nt, Artificial Sequence
  Synthetic
  misc_feature (1)..(2): linked via phosphorothioate
  modified_base (1)..(1): 2'-O-methyl modified
  modified_base (2)..(2): 2'-O-methyl modified
  modified_base (3)..(3): 2'-O-methyl modified
  modified_base (4)..(4): 2'-O-methyl modified
  modified_base (5)..(5): 2'-O-methyl modified
  modified_base (6)..(6): 2'-O-methyl modified
  modified_base (7)..(7): 2'-O-methyl modified
  modified_base (8)..(8): 2'-fluoro modified
  modified_base (9)..(9): 2'-fluoro modified
  modified_base (10)..(10): 2'-fluoro modified
  modified_base (11)..(11): 2'-fluoro modified
  modified_base (12)..(12): 2'-O-methyl modified
  modified_base (13)..(13): 2'-O-methyl modified
  modified_base (14)..(14): 2'-O-methyl modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  modified_base (20)..(20): 2'-O-methyl modified
  modified_base (21)..(21): 2'-O-methyl modified
  modified_base (22)..(22): 2'-O-methyl modified
  modified_base (23)..(23): 2'-O-methyl modified
  modified_base (24)..(24): 2'-O-methyl modified
  modified_base (25)..(25): 2'-O-methyl modified
  modified_base (26)..(26): 2'-O-methyl modified
  modified_base (27)..(27): 2'-O-methyl modified
  modified_base (28)..(28): GalNAc-conjugated
  modified_base (29)..(29): GalNAc-conjugated
  modified_base (30)..(30): GalNAc-conjugated
  modified_base (31)..(31): 2'-O-methyl modified
  modified_base (32)..(32): 2'-O-methyl modified
  modified_base (33)..(33): 2'-O-methyl modified
  modified_base (34)..(34): 2'-O-methyl modified
  modified_base (35)..(35): 2'-O-methyl modified
  modified_base (36)..(36): 2'-O-methyl modified
uggcauuaaaagagagucaagcagccgaaaggcugc

SEQ ID NO: 1033 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uuguucuucugacaggacacgg

SEQ ID NO: 1034 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uucuguucuucugacaggacgg

SEQ ID NO: 1035 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
ugaucuguucuucugacagggg

SEQ ID NO: 1036 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uggaucuguucuucugacaggg

SEQ ID NO: 1037 - RNA, 22 nt, Artificial Sequence
  Synthetic
  misc_feature (1)..(3): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-O-methyl modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
ucggaucuguucuucugacagg

SEQ ID NO: 1038 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
ucucuugccgcuucaguuucgg

SEQ ID NO: 1039 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uaugucuccagaagcaucacgg

SEQ ID NO: 1040 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uaaggugauacucucacuccgg

SEQ ID NO: 1041 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uuugaggaaggugauacucugg

SEQ ID NO: 1042 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uaauccuugaggaaggugaugg

SEQ ID NO: 1043 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uaaauccuugaggaaggugagg

SEQ ID NO: 1044 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
ugaaauccuugaggaagguggg

SEQ ID NO: 1045 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uugaaauccuugaggaaggugg

SEQ ID NO: 1046 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
ucugaaauccuugaggaagggg

SEQ ID NO: 1047 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uacugaaauccuugaggaaggg

SEQ ID NO: 1048 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uaacugaaauccuugaggaagg

SEQ ID NO: 1049 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uuaacugaaauccuugaggagg

SEQ ID NO: 1050 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uauaacugaaauccuugagggg

SEQ ID NO: 1051 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uuauaacugaaauccuugaggg

SEQ ID NO: 1052 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uuuauaacugaaauccuugagg

SEQ ID NO: 1053 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uguuauaacugaaauccuuggg

SEQ ID NO: 1054 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
ugguuauaacugaaauccuugg

SEQ ID NO: 1055 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
ucgguuauaacugaaauccugg

SEQ ID NO: 1056 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uccgguuauaacugaaauccgg

SEQ ID NO: 1057 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
ugucuucccgguuauaacuggg

SEQ ID NO: 1058 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uagucuucccgguuauaacugg

SEQ ID NO: 1059 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
ucaaagucuucccgguuauagg

SEQ ID NO: 1060 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
ucacuugcagcccugcuuuggg

SEQ ID NO: 1061 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uaauuccacuugcagcccuggg

SEQ ID NO: 1062 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uaugaauuccacuugcagccgg

SEQ ID NO: 1063 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uugaugaauuccacuugcaggg

SEQ ID NO: 1064 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uuugaugaauuccacuugcagg

SEQ ID NO: 1065 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uguugaugaauuccacuugcgg

SEQ ID NO: 1066 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
ugguugaugaauuccacuuggg

SEQ ID NO: 1067 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
ugggguugaugaauuccacugg

SEQ ID NO: 1068 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uugggguugaugaauuccacgg

SEQ ID NO: 1069 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uaugggguugaugaauuccagg

SEQ ID NO: 1070 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uagaugggguugaugaauucgg

SEQ ID NO: 1071 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uaagaugggguugaugaauugg

SEQ ID NO: 1072 - RNA, 22 nt, Artificial Sequence
  Synthetic
  misc_feature (1)..(3): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
ugaagaugggguugaugaaugg

SEQ ID NO: 1073 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
ucgaagaugggguugaugaagg

SEQ ID NO: 1074 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uuccacauaugugugcugcagg

SEQ ID NO: 1075 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uggcuuccacauaugugugcgg

SEQ ID NO: 1076 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uauggagacguaggcaugcagg

SEQ ID NO: 1077 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uguggauggagacguaggcagg

SEQ ID NO: 1078 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
ugaugguggauggagacguagg

SEQ ID NO: 1079 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
ugggaugguggauggagacggg

SEQ ID NO: 1080 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uggucauggggaugguggaugg

SEQ ID NO: 1081 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uggaacaucagucggucauggg

SEQ ID NO: 1082 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uccgugggaacaucagucgggg

SEQ ID NO: 1083 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uuccgugggaacaucagucggg

SEQ ID NO: 1084 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uauccgugggaacaucagucgg

SEQ ID NO: 1085 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
ugcauccgugggaacaucaggg

SEQ ID NO: 1086 - RNA, 22 nt, Artificial Sequence
  Synthetic
  misc_feature (1)..(3): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-O-methyl modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uuagcauccgugggaacaucgg

SEQ ID NO: 1087 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uuuagcauccgugggaacaugg

SEQ ID NO: 1088 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uuuucauuagcauccguggggg

SEQ ID NO: 1089 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uccaguuucauuagcauccggg

SEQ ID NO: 1090 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uaccaguuucauuagcauccgg

SEQ ID NO: 1091 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
ucaccaguuucauuagcaucgg

SEQ ID NO: 1092 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uucaccaguuucauuagcaugg

SEQ ID NO: 1093 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uggcucaccaguuucauuaggg

SEQ ID NO: 1094 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
ugcucugaguggacgcugcugg

SEQ ID NO: 1095 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uuugcucugaguggacgcuggg

SEQ ID NO: 1096 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
ucuugcucugaguggacgcugg

SEQ ID NO: 1097 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
ucaaacacuugcucugaguggg

SEQ ID NO: 1098 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
ugacgcagugcaaacacuuggg

SEQ ID NO: 1099 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
ucagacgcagugcaaacacugg

SEQ ID NO: 1100 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uuuuuguccugcagacgcaggg

SEQ ID NO: 1101 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
ugugggagcuuuuuguccuggg

SEQ ID NO: 1102 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
ugcacaucccagaucucagagg

SEQ ID NO: 1103 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uuucgugcacaucccagaucgg

SEQ ID NO: 1104 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uauucgugcacaucccagaugg

SEQ ID NO: 1105 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
ucauucgugcacaucccagagg

SEQ ID NO: 1106 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uaacagucauucgugcacaugg

SEQ ID NO: 1107 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
ugaacagucauucgugcacagg

SEQ ID NO: 1108 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uagaacagucauucgugcacgg

SEQ ID NO: 1109 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uguuccacuucuaggaggcagg

SEQ ID NO: 1110 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uucagucuguuccacuucuagg

SEQ ID NO: 1111 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
ucucagucuguuccacuucugg

SEQ ID NO: 1112 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uucucagucuguuccacuucgg

SEQ ID NO: 1113 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uuucucagucuguuccacuugg

SEQ ID NO: 1114 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
ucuucucagucuguuccacugg

SEQ ID NO: 1115 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uccuucucagucuguuccacgg

SEQ ID NO: 1116 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
ucccuucucagucuguuccagg

SEQ ID NO: 1117 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uugcccuucucagucuguucgg

SEQ ID NO: 1118 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uaauguuugcccuucucagugg

SEQ ID NO: 1119 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
ugacucucuuuuaaugccacgg

SEQ ID NO: 1120 - RNA, 22 nt, Artificial Sequence
  Synthetic
  misc_feature (1)..(4): linked via phosphorothioate
  modified_base (1)..(1): 5'-methoxyphosphonate-4-oxy modified
  modified_base (2)..(2): 2'-fluoro modified
  modified_base (3)..(3): 2'-fluoro modified
  modified_base (4)..(4): 2'-fluoro modified
  modified_base (5)..(5): 2'-fluoro modified
  modified_base (6)..(6): 2'-O-methyl modified
  modified_base (7)..(7): 2'-fluoro modified
  modified_base (8)..(8): 2'-O-methyl modified
  modified_base (9)..(9): 2'-O-methyl modified
  modified_base (10)..(10): 2'-fluoro modified
  modified_base (11)..(11): 2'-O-methyl modified
  modified_base (12)..(12): 2'-O-methyl modified
  modified_base (13)..(13): 2'-O-methyl modified
  modified_base (14)..(14): 2'-fluoro modified
  modified_base (15)..(15): 2'-O-methyl modified
  modified_base (16)..(16): 2'-O-methyl modified
  modified_base (17)..(17): 2'-O-methyl modified
  modified_base (18)..(18): 2'-O-methyl modified
  modified_base (19)..(19): 2'-O-methyl modified
  misc_feature (20)..(22): linked via phosphorothioate
  modified_base (20)..(20): 2'-O-methyl modified
  modified_base (21)..(21): 2'-O-methyl modified
  modified_base (22)..(22): 2'-O-methyl modified
uugacucucuuuuaaugccagg

SEQ ID NO: 1121 - RNA, 16 nt, Artificial Sequence
  Synthetic
gcagccgaaaggcugc

SEQ ID NO: 1122 - DNA, 22 bp, Artificial Sequence
  Synthetic
gttataaccgggaagactttgc

SEQ ID NO: 1123 - DNA, 20 bp, Artificial Sequence
  Synthetic
tgatagcaatgagcaaggca

SEQ ID NO: 1124 - DNA, 24 bp, Artificial Sequence
  Synthetic
atggccctggagaactcgaagatg

SEQ ID NO: 1125 - RNA, 19 nt, Artificial Sequence
  Synthetic
uguccugucagaagaacag

SEQ ID NO: 1126 - RNA, 19 nt, Artificial Sequence
  Synthetic
uccugucagaagaacagau

SEQ ID NO: 1127 - RNA, 19 nt, Artificial Sequence
  Synthetic
cugaagaaacugaagcggc

SEQ ID NO: 1128 - RNA, 19 nt, Artificial Sequence
  Synthetic
ugaagaaacugaagcggca

SEQ ID NO: 1129 - RNA, 19 nt, Artificial Sequence
  Synthetic
gaagaaacugaagcggcaa

SEQ ID NO: 1130 - RNA, 19 nt, Artificial Sequence
  Synthetic
aagaaacugaagcggcaag

SEQ ID NO: 1131 - RNA, 19 nt, Artificial Sequence
  Synthetic
agaaacugaagcggcaaga

SEQ ID NO: 1132 - RNA, 19 nt, Artificial Sequence
  Synthetic
aaacugaagcggcaagagg

SEQ ID NO: 1133 - RNA, 19 nt, Artificial Sequence
  Synthetic
aacugaagcggcaagagga

SEQ ID NO: 1134 - RNA, 19 nt, Artificial Sequence
  Synthetic
acugaagcggcaagaggag

SEQ ID NO: 1135 - RNA, 19 nt, Artificial Sequence
  Synthetic
cugaagcggcaagaggagg

SEQ ID NO: 1136 - RNA, 19 nt, Artificial Sequence
  Synthetic
ugaagcggcaagaggagga

SEQ ID NO: 1137 - RNA, 19 nt, Artificial Sequence
  Synthetic
agcggcaagaggaggaaca

SEQ ID NO: 1138 - RNA, 19 nt, Artificial Sequence
  Synthetic
gcggcaagaggaggaacag

SEQ ID NO: 1139 - RNA, 19 nt, Artificial Sequence
  Synthetic
cggcaagaggaggaacagg

SEQ ID NO: 1140 - RNA, 19 nt, Artificial Sequence
  Synthetic
gcaagaggaggaacaggcu

SEQ ID NO: 1141 - RNA, 19 nt, Artificial Sequence
  Synthetic
aagaggaggaacaggcuca

SEQ ID NO: 1142 - RNA, 19 nt, Artificial Sequence
  Synthetic
agaggaggaacaggcucau

SEQ ID NO: 1143 - RNA, 19 nt, Artificial Sequence
  Synthetic
gaggaggaacaggcucaug

SEQ ID NO: 1144 - RNA, 19 nt, Artificial Sequence
  Synthetic
aggaggaacaggcucaugc

SEQ ID NO: 1145 - RNA, 19 nt, Artificial Sequence
  Synthetic
gaggaacaggcucaugcca

SEQ ID NO: 1146 - RNA, 19 nt, Artificial Sequence
  Synthetic
ccagggcuuccucaccccc

SEQ ID NO: 1147 - RNA, 19 nt, Artificial Sequence
  Synthetic
ugggcaugaucgagaagcu

SEQ ID NO: 1148 - RNA, 19 nt, Artificial Sequence
  Synthetic
gcaugaucgagaagcucgu

SEQ ID NO: 1149 - RNA, 19 nt, Artificial Sequence
  Synthetic
gucgcugcccagcaacagu

SEQ ID NO: 1150 - RNA, 19 nt, Artificial Sequence
  Synthetic
cgcugcccagcaacagugu

SEQ ID NO: 1151 - RNA, 19 nt, Artificial Sequence
  Synthetic
cccagcaacaguguaaccg

SEQ ID NO: 1152 - RNA, 19 nt, Artificial Sequence
  Synthetic
cagcaacaguguaaccggc

SEQ ID NO: 1153 - RNA, 19 nt, Artificial Sequence
  Synthetic
agcaacaguguaaccggcg

SEQ ID NO: 1154 - RNA, 19 nt, Artificial Sequence
  Synthetic
caacaguguaaccggcgcu

SEQ ID NO: 1155 - RNA, 19 nt, Artificial Sequence
  Synthetic
aacaguguaaccggcgcuc

SEQ ID NO: 1156 - RNA, 19 nt, Artificial Sequence
  Synthetic
acaguguaaccggcgcucc

SEQ ID NO: 1157 - RNA, 19 nt, Artificial Sequence
  Synthetic
caguguaaccggcgcuccu

SEQ ID NO: 1158 - RNA, 19 nt, Artificial Sequence
  Synthetic
aguguaaccggcgcuccuu

SEQ ID NO: 1159 - RNA, 19 nt, Artificial Sequence
  Synthetic
guguaaccggcgcuccuuu

SEQ ID NO: 1160 - RNA, 19 nt, Artificial Sequence
  Synthetic
uguaaccggcgcuccuuuu

SEQ ID NO: 1161 - RNA, 19 nt, Artificial Sequence
  Synthetic
gcgcuccuuuucugaccgg

SEQ ID NO: 1162 - RNA, 19 nt, Artificial Sequence
  Synthetic
cuccuuuucugaccggcuu

SEQ ID NO: 1163 - RNA, 19 nt, Artificial Sequence
  Synthetic
uccuuuucugaccggcuuc

SEQ ID NO: 1164 - RNA, 19 nt, Artificial Sequence
  Synthetic
ccuuuucugaccggcuucg

SEQ ID NO: 1165 - RNA, 19 nt, Artificial Sequence
  Synthetic
cuuuucugaccggcuucga

SEQ ID NO: 1166 - RNA, 19 nt, Artificial Sequence
  Synthetic
uuucugaccggcuucgagu

SEQ ID NO: 1167 - RNA, 19 nt, Artificial Sequence
  Synthetic
ucugaccggcuucgaguca

SEQ ID NO: 1168 - RNA, 19 nt, Artificial Sequence
  Synthetic
cugaccggcuucgagucac

SEQ ID NO: 1169 - RNA, 19 nt, Artificial Sequence
  Synthetic
ugaccggcuucgagucacg

SEQ ID NO: 1170 - RNA, 19 nt, Artificial Sequence
  Synthetic
ggugaugcuucuggagaca

SEQ ID NO: 1171 - RNA, 19 nt, Artificial Sequence
  Synthetic
ugaugcuucuggagacauc

SEQ ID NO: 1172 - RNA, 19 nt, Artificial Sequence
  Synthetic
gaugcuucuggagacaucu

SEQ ID NO: 1173 - RNA, 19 nt, Artificial Sequence
  Synthetic
augcuucuggagacaucuc

SEQ ID NO: 1174 - RNA, 19 nt, Artificial Sequence
  Synthetic
ugcuucuggagacaucucg

SEQ ID NO: 1175 - RNA, 19 nt, Artificial Sequence
  Synthetic
gcuucuggagacaucucgg

SEQ ID NO: 1176 - RNA, 19 nt, Artificial Sequence
  Synthetic
cuucuggagacaucucgga

SEQ ID NO: 1177 - RNA, 19 nt, Artificial Sequence
  Synthetic
uucuggagacaucucggag

SEQ ID NO: 1178 - RNA, 19 nt, Artificial Sequence
  Synthetic
ucuggagacaucucggagg

SEQ ID NO: 1179 - RNA, 19 nt, Artificial Sequence
  Synthetic
cuggagacaucucggaggu

SEQ ID NO: 1180 - RNA, 19 nt, Artificial Sequence
  Synthetic
uggagacaucucggaggua

SEQ ID NO: 1181 - RNA, 19 nt, Artificial Sequence
  Synthetic
ggagacaucucggagguac

SEQ ID NO: 1182 - RNA, 19 nt, Artificial Sequence
  Synthetic
gagacaucucggagguaca

SEQ ID NO: 1183 - RNA, 19 nt, Artificial Sequence
  Synthetic
agacaucucggagguacaa

SEQ ID NO: 1184 - RNA, 19 nt, Artificial Sequence
  Synthetic
gacaucucggagguacaac

SEQ ID NO: 1185 - RNA, 19 nt, Artificial Sequence
  Synthetic
acaucucggagguacaacc

SEQ ID NO: 1186 - RNA, 19 nt, Artificial Sequence
  Synthetic
aucucggagguacaacccu

SEQ ID NO: 1187 - RNA, 19 nt, Artificial Sequence
  Synthetic
ucucggagguacaacccug

SEQ ID NO: 1188 - RNA, 19 nt, Artificial Sequence
  Synthetic
cucggagguacaacccugg

SEQ ID NO: 1189 - RNA, 19 nt, Artificial Sequence
  Synthetic
cggagguacaacccuggga

SEQ ID NO: 1190 - RNA, 19 nt, Artificial Sequence
  Synthetic
gagguacaacccugggagu

SEQ ID NO: 1191 - RNA, 19 nt, Artificial Sequence
  Synthetic
agguacaacccugggagug

SEQ ID NO: 1192 - RNA, 19 nt, Artificial Sequence
  Synthetic
gguacaacccugggaguga

SEQ ID NO: 1193 - RNA, 19 nt, Artificial Sequence
  Synthetic
guacaacccugggagugag

SEQ ID NO: 1194 - RNA, 19 nt, Artificial Sequence
  Synthetic
uacaacccugggagugaga

SEQ ID NO: 1195 - RNA, 19 nt, Artificial Sequence
  Synthetic
acaacccugggagugagag

SEQ ID NO: 1196 - RNA, 19 nt, Artificial Sequence
  Synthetic
caacccugggagugagagu

SEQ ID NO: 1197 - RNA, 19 nt, Artificial Sequence
  Synthetic
aacccugggagugagagua

SEQ ID NO: 1198 - RNA, 19 nt, Artificial Sequence
  Synthetic
acccugggagugagaguau

SEQ ID NO: 1199 - RNA, 19 nt, Artificial Sequence
  Synthetic
cccugggagugagaguauc

SEQ ID NO: 1200 - RNA, 19 nt, Artificial Sequence
  Synthetic
ccugggagugagaguauca

SEQ ID NO: 1201 - RNA, 19 nt, Artificial Sequence
  Synthetic
cugggagugagaguaucac

SEQ ID NO: 1202 - RNA, 19 nt, Artificial Sequence
  Synthetic
ugggagugagaguaucacc

SEQ ID NO: 1203 - RNA, 19 nt, Artificial Sequence
  Synthetic
gggagugagaguaucaccu

SEQ ID NO: 1204 - RNA, 19 nt, Artificial Sequence
  Synthetic
gagugagaguaucaccuuc

SEQ ID NO: 1205 - RNA, 19 nt, Artificial Sequence
  Synthetic
agugagaguaucaccuucc

SEQ ID NO: 1206 - RNA, 19 nt, Artificial Sequence
  Synthetic
gugagaguaucaccuuccu

SEQ ID NO: 1207 - RNA, 19 nt, Artificial Sequence
  Synthetic
ugagaguaucaccuuccuc

SEQ ID NO: 1208 - RNA, 19 nt, Artificial Sequence
  Synthetic
gagaguaucaccuuccuca

SEQ ID NO: 1209 - RNA, 19 nt, Artificial Sequence
  Synthetic
gaguaucaccuuccucaag

SEQ ID NO: 1210 - RNA, 19 nt, Artificial Sequence
  Synthetic
aguaucaccuuccucaagg

SEQ ID NO: 1211 - RNA, 19 nt, Artificial Sequence
  Synthetic
guaucaccuuccucaagga

SEQ ID NO: 1212 - RNA, 19 nt, Artificial Sequence
  Synthetic
uaucaccuuccucaaggau

SEQ ID NO: 1213 - RNA, 19 nt, Artificial Sequence
  Synthetic
aucaccuuccucaaggauu

SEQ ID NO: 1214 - RNA, 19 nt, Artificial Sequence
  Synthetic
accuuccucaaggauuuca

SEQ ID NO: 1215 - RNA, 19 nt, Artificial Sequence
  Synthetic
ccuuccucaaggauuucag

SEQ ID NO: 1216 - RNA, 19 nt, Artificial Sequence
  Synthetic
uccucaaggauuucaguua

SEQ ID NO: 1217 - RNA, 19 nt, Artificial Sequence
  Synthetic
caaggauuucaguuauaac

SEQ ID NO: 1218 - RNA, 19 nt, Artificial Sequence
  Synthetic
aaggauuucaguuauaacc

SEQ ID NO: 1219 - RNA, 19 nt, Artificial Sequence
  Synthetic
aggauuucaguuauaaccg

SEQ ID NO: 1220 - RNA, 19 nt, Artificial Sequence
  Synthetic
ggauuucaguuauaaccgg

SEQ ID NO: 1221 - RNA, 19 nt, Artificial Sequence
  Synthetic
gauuucaguuauaaccggg

SEQ ID NO: 1222 - RNA, 19 nt, Artificial Sequence
  Synthetic
auuucaguuauaaccggga

SEQ ID NO: 1223 - RNA, 19 nt, Artificial Sequence
  Synthetic
uuucaguuauaaccgggaa

SEQ ID NO: 1224 - RNA, 19 nt, Artificial Sequence
  Synthetic
uucaguuauaaccgggaag

SEQ ID NO: 1225 - RNA, 19 nt, Artificial Sequence
  Synthetic
ucaguuauaaccgggaaga

SEQ ID NO: 1226 - RNA, 19 nt, Artificial Sequence
  Synthetic
caguuauaaccgggaagac

SEQ ID NO: 1227 - RNA, 19 nt, Artificial Sequence
  Synthetic
guuauaaccgggaagacuu

SEQ ID NO: 1228 - RNA, 19 nt, Artificial Sequence
  Synthetic
uuauaaccgggaagacuuu

SEQ ID NO: 1229 - RNA, 19 nt, Artificial Sequence
  Synthetic
uauaaccgggaagacuuug

SEQ ID NO: 1230 - RNA, 19 nt, Artificial Sequence
  Synthetic
auaaccgggaagacuuugc

SEQ ID NO: 1231 - RNA, 19 nt, Artificial Sequence
  Synthetic
uaaccgggaagacuuugcc

SEQ ID NO: 1232 - RNA, 19 nt, Artificial Sequence
  Synthetic
aaccgggaagacuuugcca

SEQ ID NO: 1233 - RNA, 19 nt, Artificial Sequence
  Synthetic
accgggaagacuuugccaa

SEQ ID NO: 1234 - RNA, 19 nt, Artificial Sequence
  Synthetic
ccgggaagacuuugccaaa

SEQ ID NO: 1235 - RNA, 19 nt, Artificial Sequence
  Synthetic
ggaagacuuugccaaagca

SEQ ID NO: 1236 - RNA, 19 nt, Artificial Sequence
  Synthetic
gaagacuuugccaaagcag

SEQ ID NO: 1237 - RNA, 19 nt, Artificial Sequence
  Synthetic
aagacuuugccaaagcagg

SEQ ID NO: 1238 - RNA, 19 nt, Artificial Sequence
  Synthetic
agacuuugccaaagcaggg

SEQ ID NO: 1239 - RNA, 19 nt, Artificial Sequence
  Synthetic
gacuuugccaaagcagggc

SEQ ID NO: 1240 - RNA, 19 nt, Artificial Sequence
  Synthetic
acuuugccaaagcagggcu

SEQ ID NO: 1241 - RNA, 19 nt, Artificial Sequence
  Synthetic
cuuugccaaagcagggcug

SEQ ID NO: 1242 - RNA, 19 nt, Artificial Sequence
  Synthetic
ugccaaagcagggcugcaa

SEQ ID NO: 1243 - RNA, 19 nt, Artificial Sequence
  Synthetic
gccaaagcagggcugcaag

SEQ ID NO: 1244 - RNA, 19 nt, Artificial Sequence
  Synthetic
ccaaagcagggcugcaagu

SEQ ID NO: 1245 - RNA, 19 nt, Artificial Sequence
  Synthetic
caaagcagggcugcaagug

SEQ ID NO: 1246 - RNA, 19 nt, Artificial Sequence
  Synthetic
aaagcagggcugcaagugg

SEQ ID NO: 1247 - RNA, 19 nt, Artificial Sequence
  Synthetic
aagcagggcugcaagugga

SEQ ID NO: 1248 - RNA, 19 nt, Artificial Sequence
  Synthetic
agcagggcugcaaguggaa

SEQ ID NO: 1249 - RNA, 19 nt, Artificial Sequence
  Synthetic
gcagggcugcaaguggaau

SEQ ID NO: 1250 - RNA, 19 nt, Artificial Sequence
  Synthetic
agggcugcaaguggaauuc

SEQ ID NO: 1251 - RNA, 19 nt, Artificial Sequence
  Synthetic
gggcugcaaguggaauuca

SEQ ID NO: 1252 - RNA, 19 nt, Artificial Sequence
  Synthetic
ggcugcaaguggaauucau

SEQ ID NO: 1253 - RNA, 19 nt, Artificial Sequence
  Synthetic
gcugcaaguggaauucauc

SEQ ID NO: 1254 - RNA, 19 nt, Artificial Sequence
  Synthetic
gcaaguggaauucaucaac

SEQ ID NO: 1255 - RNA, 19 nt, Artificial Sequence
  Synthetic
aaguggaauucaucaaccc

SEQ ID NO: 1256 - RNA, 19 nt, Artificial Sequence
  Synthetic
aguggaauucaucaacccc

SEQ ID NO: 1257 - RNA, 19 nt, Artificial Sequence
  Synthetic
uggaauucaucaaccccau

SEQ ID NO: 1258 - RNA, 19 nt, Artificial Sequence
  Synthetic
ggaauucaucaaccccauc

SEQ ID NO: 1259 - RNA, 19 nt, Artificial Sequence
  Synthetic
auucaucaaccccaucuuc

SEQ ID NO: 1260 - RNA, 19 nt, Artificial Sequence
  Synthetic
uucaucaaccccaucuucg

SEQ ID NO: 1261 - RNA, 19 nt, Artificial Sequence
  Synthetic
ucaucaaccccaucuucga

SEQ ID NO: 1262 - RNA, 19 nt, Artificial Sequence
  Synthetic
caucaaccccaucuucgag

SEQ ID NO: 1263 - RNA, 19 nt, Artificial Sequence
  Synthetic
aucaaccccaucuucgagu

SEQ ID NO: 1264 - RNA, 19 nt, Artificial Sequence
  Synthetic
ucaaccccaucuucgaguu

SEQ ID NO: 1265 - RNA, 19 nt, Artificial Sequence
  Synthetic
caaccccaucuucgaguuc

SEQ ID NO: 1266 - RNA, 19 nt, Artificial Sequence
  Synthetic
aaccccaucuucgaguucu

SEQ ID NO: 1267 - RNA, 19 nt, Artificial Sequence
  Synthetic
accccaucuucgaguucuc

SEQ ID NO: 1268 - RNA, 19 nt, Artificial Sequence
  Synthetic
cccaucuucgaguucucca

SEQ ID NO: 1269 - RNA, 19 nt, Artificial Sequence
  Synthetic
ccaucuucgaguucuccag

SEQ ID NO: 1270 - RNA, 19 nt, Artificial Sequence
  Synthetic
caucuucgaguucuccagg

SEQ ID NO: 1271 - RNA, 19 nt, Artificial Sequence
  Synthetic
aucuucgaguucuccaggg

SEQ ID NO: 1272 - RNA, 19 nt, Artificial Sequence
  Synthetic
ucuucgaguucuccagggc

SEQ ID NO: 1273 - RNA, 19 nt, Artificial Sequence
  Synthetic
cuucgaguucuccagggcc

SEQ ID NO: 1274 - RNA, 19 nt, Artificial Sequence
  Synthetic
uucgaguucuccagggcca

SEQ ID NO: 1275 - RNA, 19 nt, Artificial Sequence
  Synthetic
ucgaguucuccagggccau

SEQ ID NO: 1276 - RNA, 19 nt, Artificial Sequence
  Synthetic
cgaguucuccagggccaug

SEQ ID NO: 1277 - RNA, 19 nt, Artificial Sequence
  Synthetic
gaguucuccagggccauga

SEQ ID NO: 1278 - RNA, 19 nt, Artificial Sequence
  Synthetic
aguucuccagggccaugaa

SEQ ID NO: 1279 - RNA, 19 nt, Artificial Sequence
  Synthetic
guucuccagggccaugaau

SEQ ID NO: 1280 - RNA, 19 nt, Artificial Sequence
  Synthetic
ucuccagggccaugaauga

SEQ ID NO: 1281 - RNA, 19 nt, Artificial Sequence
  Synthetic
cuccagggccaugaaugag

SEQ ID NO: 1282 - RNA, 19 nt, Artificial Sequence
  Synthetic
uccagggccaugaaugagc

SEQ ID NO: 1283 - RNA, 19 nt, Artificial Sequence
  Synthetic
ccagggccaugaaugagcu

SEQ ID NO: 1284 - RNA, 19 nt, Artificial Sequence
  Synthetic
cagggccaugaaugagcug

SEQ ID NO: 1285 - RNA, 19 nt, Artificial Sequence
  Synthetic
agggccaugaaugagcugc

SEQ ID NO: 1286 - RNA, 19 nt, Artificial Sequence
  Synthetic
gggccaugaaugagcugca

SEQ ID NO: 1287 - RNA, 19 nt, Artificial Sequence
  Synthetic
ggccaugaaugagcugcaa

SEQ ID NO: 1288 - RNA, 19 nt, Artificial Sequence
  Synthetic
gccaugaaugagcugcaac

SEQ ID NO: 1289 - RNA, 19 nt, Artificial Sequence
  Synthetic
ccaugaaugagcugcaacu

SEQ ID NO: 1290 - RNA, 19 nt, Artificial Sequence
  Synthetic
cucauugcuaucagcaucu

SEQ ID NO: 1291 - RNA, 19 nt, Artificial Sequence
  Synthetic
ucauugcuaucagcaucuu

SEQ ID NO: 1292 - RNA, 19 nt, Artificial Sequence
  Synthetic
cauugcuaucagcaucuuc

SEQ ID NO: 1293 - RNA, 19 nt, Artificial Sequence
  Synthetic
auugcuaucagcaucuucu

SEQ ID NO: 1294 - RNA, 19 nt, Artificial Sequence
  Synthetic
uugcuaucagcaucuucuc

SEQ ID NO: 1295 - RNA, 19 nt, Artificial Sequence
  Synthetic
ugcuaucagcaucuucucu

SEQ ID NO: 1296 - RNA, 19 nt, Artificial Sequence
  Synthetic
gcuaucagcaucuucucug

SEQ ID NO: 1297 - RNA, 19 nt, Artificial Sequence
  Synthetic
cuaucagcaucuucucugc

SEQ ID NO: 1298 - RNA, 19 nt, Artificial Sequence
  Synthetic
uaucagcaucuucucugca

SEQ ID NO: 1299 - RNA, 19 nt, Artificial Sequence
  Synthetic
aucagcaucuucucugcag

SEQ ID NO: 1300 - RNA, 19 nt, Artificial Sequence
  Synthetic
gugcaggaccagcuccagg

SEQ ID NO: 1301 - RNA, 19 nt, Artificial Sequence
  Synthetic
gcaggaccagcuccaggua

SEQ ID NO: 1302 - RNA, 19 nt, Artificial Sequence
  Synthetic
gaccagcuccagguagaga

SEQ ID NO: 1303 - RNA, 19 nt, Artificial Sequence
  Synthetic
accagcuccagguagagag

SEQ ID NO: 1304 - RNA, 19 nt, Artificial Sequence
  Synthetic
ccagcuccagguagagagg

SEQ ID NO: 1305 - RNA, 19 nt, Artificial Sequence
  Synthetic
agcuccagguagagaggcu

SEQ ID NO: 1306 - RNA, 19 nt, Artificial Sequence
  Synthetic
gcuccagguagagaggcug

SEQ ID NO: 1307 - RNA, 19 nt, Artificial Sequence
  Synthetic
ccagguagagaggcugcag

SEQ ID NO: 1308 - RNA, 19 nt, Artificial Sequence
  Synthetic
agguagagaggcugcagca

SEQ ID NO: 1309 - RNA, 19 nt, Artificial Sequence
  Synthetic
gguagagaggcugcagcac

SEQ ID NO: 1310 - RNA, 19 nt, Artificial Sequence
  Synthetic
guagagaggcugcagcaca

SEQ ID NO: 1311 - RNA, 19 nt, Artificial Sequence
  Synthetic
uagagaggcugcagcacac

SEQ ID NO: 1312 - RNA, 19 nt, Artificial Sequence
  Synthetic
agagaggcugcagcacaca

SEQ ID NO: 1313 - RNA, 19 nt, Artificial Sequence
  Synthetic
gagaggcugcagcacacau

SEQ ID NO: 1314 - RNA, 19 nt, Artificial Sequence
  Synthetic
agaggcugcagcacacaua

SEQ ID NO: 1315 - RNA, 19 nt, Artificial Sequence
  Synthetic
gaggcugcagcacacauau

SEQ ID NO: 1316 - RNA, 19 nt, Artificial Sequence
  Synthetic
aggcugcagcacacauaug

SEQ ID NO: 1317 - RNA, 19 nt, Artificial Sequence
  Synthetic
ggcugcagcacacauaugu

SEQ ID NO: 1318 - RNA, 19 nt, Artificial Sequence
  Synthetic
gcugcagcacacauaugug

SEQ ID NO: 1319 - RNA, 19 nt, Artificial Sequence
  Synthetic
cugcagcacacauaugugg

SEQ ID NO: 1320 - RNA, 19 nt, Artificial Sequence
  Synthetic
gcagcacacauauguggaa

SEQ ID NO: 1321 - RNA, 19 nt, Artificial Sequence
  Synthetic
cagcacacauauguggaag

SEQ ID NO: 1322 - RNA, 19 nt, Artificial Sequence
  Synthetic
agcacacauauguggaagc

SEQ ID NO: 1323 - RNA, 19 nt, Artificial Sequence
  Synthetic
cacacauauguggaagccc

SEQ ID NO: 1324 - RNA, 19 nt, Artificial Sequence
  Synthetic
acacauauguggaagcccu

SEQ ID NO: 1325 - RNA, 19 nt, Artificial Sequence
  Synthetic
cacauauguggaagcccug

SEQ ID NO: 1326 - RNA, 19 nt, Artificial Sequence
  Synthetic
acauauguggaagcccugc

SEQ ID NO: 1327 - RNA, 19 nt, Artificial Sequence
  Synthetic
cauauguggaagcccugca

SEQ ID NO: 1328 - RNA, 19 nt, Artificial Sequence
  Synthetic
auauguggaagcccugcau

SEQ ID NO: 1329 - RNA, 19 nt, Artificial Sequence
  Synthetic
uauguggaagcccugcaug

SEQ ID NO: 1330 - RNA, 19 nt, Artificial Sequence
  Synthetic
auguggaagcccugcaugc

SEQ ID NO: 1331 - RNA, 19 nt, Artificial Sequence
  Synthetic
uguggaagcccugcaugcc

SEQ ID NO: 1332 - RNA, 19 nt, Artificial Sequence
  Synthetic
guggaagcccugcaugccu

SEQ ID NO: 1333 - RNA, 19 nt, Artificial Sequence
  Synthetic
uggaagcccugcaugccua

SEQ ID NO: 1334 - RNA, 19 nt, Artificial Sequence
  Synthetic
ggaagcccugcaugccuac

SEQ ID NO: 1335 - RNA, 19 nt, Artificial Sequence
  Synthetic
gaagcccugcaugccuacg

SEQ ID NO: 1336 - RNA, 19 nt, Artificial Sequence
  Synthetic
aagcccugcaugccuacgu

SEQ ID NO: 1337 - RNA, 19 nt, Artificial Sequence
  Synthetic
agcccugcaugccuacguc

SEQ ID NO: 1338 - RNA, 19 nt, Artificial Sequence
  Synthetic
gcccugcaugccuacgucu

SEQ ID NO: 1339 - RNA, 19 nt, Artificial Sequence
  Synthetic
cccugcaugccuacgucuc

SEQ ID NO: 1340 - RNA, 19 nt, Artificial Sequence
  Synthetic
ccugcaugccuacgucucc

SEQ ID NO: 1341 - RNA, 19 nt, Artificial Sequence
  Synthetic
cugcaugccuacgucucca

SEQ ID NO: 1342 - RNA, 19 nt, Artificial Sequence
  Synthetic
ugcaugccuacgucuccau

SEQ ID NO: 1343 - RNA, 19 nt, Artificial Sequence
  Synthetic
gcaugccuacgucuccauc

SEQ ID NO: 1344 - RNA, 19 nt, Artificial Sequence
  Synthetic
caugccuacgucuccaucc

SEQ ID NO: 1345 - RNA, 19 nt, Artificial Sequence
  Synthetic
augccuacgucuccaucca

SEQ ID NO: 1346 - RNA, 19 nt, Artificial Sequence
  Synthetic
ugccuacgucuccauccac

SEQ ID NO: 1347 - RNA, 19 nt, Artificial Sequence
  Synthetic
gccuacgucuccauccacc

SEQ ID NO: 1348 - RNA, 19 nt, Artificial Sequence
  Synthetic
ccuacgucuccauccacca

SEQ ID NO: 1349 - RNA, 19 nt, Artificial Sequence
  Synthetic
cuacgucuccauccaccau

SEQ ID NO: 1350 - RNA, 19 nt, Artificial Sequence
  Synthetic
uacgucuccauccaccauc

SEQ ID NO: 1351 - RNA, 19 nt, Artificial Sequence
  Synthetic
acgucuccauccaccaucc

SEQ ID NO: 1352 - RNA, 19 nt, Artificial Sequence
  Synthetic
cgucuccauccaccauccc

SEQ ID NO: 1353 - RNA, 19 nt, Artificial Sequence
  Synthetic
gucuccauccaccaucccc

SEQ ID NO: 1354 - RNA, 19 nt, Artificial Sequence
  Synthetic
cuccauccaccauccccau

SEQ ID NO: 1355 - RNA, 19 nt, Artificial Sequence
  Synthetic
uccauccaccauccccaug

SEQ ID NO: 1356 - RNA, 19 nt, Artificial Sequence
  Synthetic
ccauccaccauccccauga

SEQ ID NO: 1357 - RNA, 19 nt, Artificial Sequence
  Synthetic
cauccaccauccccaugac

SEQ ID NO: 1358 - RNA, 19 nt, Artificial Sequence
  Synthetic
auccaccauccccaugacc

SEQ ID NO: 1359 - RNA, 19 nt, Artificial Sequence
  Synthetic
uccaccauccccaugaccg

SEQ ID NO: 1360 - RNA, 19 nt, Artificial Sequence
  Synthetic
ccaccauccccaugaccga

SEQ ID NO: 1361 - RNA, 19 nt, Artificial Sequence
  Synthetic
caccauccccaugaccgac

SEQ ID NO: 1362 - RNA, 19 nt, Artificial Sequence
  Synthetic
accauccccaugaccgacu

SEQ ID NO: 1363 - RNA, 19 nt, Artificial Sequence
  Synthetic
ccauccccaugaccgacug

SEQ ID NO: 1364 - RNA, 19 nt, Artificial Sequence
  Synthetic
cauccccaugaccgacuga

SEQ ID NO: 1365 - RNA, 19 nt, Artificial Sequence
  Synthetic
auccccaugaccgacugau

SEQ ID NO: 1366 - RNA, 19 nt, Artificial Sequence
  Synthetic
uccccaugaccgacugaug

SEQ ID NO: 1367 - RNA, 19 nt, Artificial Sequence
  Synthetic
ccccaugaccgacugaugu

SEQ ID NO: 1368 - RNA, 19 nt, Artificial Sequence
  Synthetic
cccaugaccgacugauguu

SEQ ID NO: 1369 - RNA, 19 nt, Artificial Sequence
  Synthetic
ccaugaccgacugauguuc

SEQ ID NO: 1370 - RNA, 19 nt, Artificial Sequence
  Synthetic
augaccgacugauguuccc

SEQ ID NO: 1371 - RNA, 19 nt, Artificial Sequence
  Synthetic
ugaccgacugauguuccca

SEQ ID NO: 1372 - RNA, 19 nt, Artificial Sequence
  Synthetic
gaccgacugauguucccac

SEQ ID NO: 1373 - RNA, 19 nt, Artificial Sequence
  Synthetic
accgacugauguucccacg

SEQ ID NO: 1374 - RNA, 19 nt, Artificial Sequence
  Synthetic
ccgacugauguucccacgg

SEQ ID NO: 1375 - RNA, 19 nt, Artificial Sequence
  Synthetic
gacugauguucccacggau

SEQ ID NO: 1376 - RNA, 19 nt, Artificial Sequence
  Synthetic
acugauguucccacggaug

SEQ ID NO: 1377 - RNA, 19 nt, Artificial Sequence
  Synthetic
ugauguucccacggaugcu

SEQ ID NO: 1378 - RNA, 19 nt, Artificial Sequence
  Synthetic
gauguucccacggaugcua

SEQ ID NO: 1379 - RNA, 19 nt, Artificial Sequence
  Synthetic
uguucccacggaugcuaau

SEQ ID NO: 1380 - RNA, 19 nt, Artificial Sequence
  Synthetic
guucccacggaugcuaaug

SEQ ID NO: 1381 - RNA, 19 nt, Artificial Sequence
  Synthetic
uucccacggaugcuaauga

SEQ ID NO: 1382 - RNA, 19 nt, Artificial Sequence
  Synthetic
ucccacggaugcuaaugaa

SEQ ID NO: 1383 - RNA, 19 nt, Artificial Sequence
  Synthetic
cccacggaugcuaaugaaa

SEQ ID NO: 1384 - RNA, 19 nt, Artificial Sequence
  Synthetic
ccacggaugcuaaugaaac

SEQ ID NO: 1385 - RNA, 19 nt, Artificial Sequence
  Synthetic
cacggaugcuaaugaaacu

SEQ ID NO: 1386 - RNA, 19 nt, Artificial Sequence
  Synthetic
acggaugcuaaugaaacug

SEQ ID NO: 1387 - RNA, 19 nt, Artificial Sequence
  Synthetic
cggaugcuaaugaaacugg

SEQ ID NO: 1388 - RNA, 19 nt, Artificial Sequence
  Synthetic
ggaugcuaaugaaacuggu

SEQ ID NO: 1389 - RNA, 19 nt, Artificial Sequence
  Synthetic
gaugcuaaugaaacuggug

SEQ ID NO: 1390 - RNA, 19 nt, Artificial Sequence
  Synthetic
ugcuaaugaaacuggugag

SEQ ID NO: 1391 - RNA, 19 nt, Artificial Sequence
  Synthetic
gcuaaugaaacuggugagc

SEQ ID NO: 1392 - RNA, 19 nt, Artificial Sequence
  Synthetic
cuaaugaaacuggugagcc

SEQ ID NO: 1393 - RNA, 19 nt, Artificial Sequence
  Synthetic
uaaugaaacuggugagccu

SEQ ID NO: 1394 - RNA, 19 nt, Artificial Sequence
  Synthetic
aaugaaacuggugagccuc

SEQ ID NO: 1395 - RNA, 19 nt, Artificial Sequence
  Synthetic
augaaacuggugagccucc

SEQ ID NO: 1396 - RNA, 19 nt, Artificial Sequence
  Synthetic
ugaaacuggugagccuccg

SEQ ID NO: 1397 - RNA, 19 nt, Artificial Sequence
  Synthetic
aaacuggugagccuccgga

SEQ ID NO: 1398 - RNA, 19 nt, Artificial Sequence
  Synthetic
aacuggugagccuccggac

SEQ ID NO: 1399 - RNA, 19 nt, Artificial Sequence
  Synthetic
cuggugagccuccggaccc

SEQ ID NO: 1400 - RNA, 19 nt, Artificial Sequence
  Synthetic
ccggacccugagcagcguc

SEQ ID NO: 1401 - RNA, 19 nt, Artificial Sequence
  Synthetic
ggacccugagcagcgucca

SEQ ID NO: 1402 - RNA, 19 nt, Artificial Sequence
  Synthetic
gacccugagcagcguccac

SEQ ID NO: 1403 - RNA, 19 nt, Artificial Sequence
  Synthetic
acccugagcagcguccacu

SEQ ID NO: 1404 - RNA, 19 nt, Artificial Sequence
  Synthetic
cccugagcagcguccacuc

SEQ ID NO: 1405 - RNA, 19 nt, Artificial Sequence
  Synthetic
ccugagcagcguccacuca

SEQ ID NO: 1406 - RNA, 19 nt, Artificial Sequence
  Synthetic
cugagcagcguccacucag

SEQ ID NO: 1407 - RNA, 19 nt, Artificial Sequence
  Synthetic
ugagcagcguccacucaga

SEQ ID NO: 1408 - RNA, 19 nt, Artificial Sequence
  Synthetic
gagcagcguccacucagag

SEQ ID NO: 1409 - RNA, 19 nt, Artificial Sequence
  Synthetic
agcagcguccacucagagc

SEQ ID NO: 1410 - RNA, 19 nt, Artificial Sequence
  Synthetic
gcagcguccacucagagca

SEQ ID NO: 1411 - RNA, 19 nt, Artificial Sequence
  Synthetic
cagcguccacucagagcaa

SEQ ID NO: 1412 - RNA, 19 nt, Artificial Sequence
  Synthetic
agcguccacucagagcaag

SEQ ID NO: 1413 - RNA, 19 nt, Artificial Sequence
  Synthetic
gcguccacucagagcaagu

SEQ ID NO: 1414 - RNA, 19 nt, Artificial Sequence
  Synthetic
cguccacucagagcaagug

SEQ ID NO: 1415 - RNA, 19 nt, Artificial Sequence
  Synthetic
guccacucagagcaagugu

SEQ ID NO: 1416 - RNA, 19 nt, Artificial Sequence
  Synthetic
uccacucagagcaaguguu

SEQ ID NO: 1417 - RNA, 19 nt, Artificial Sequence
  Synthetic
ccacucagagcaaguguuu

SEQ ID NO: 1418 - RNA, 19 nt, Artificial Sequence
  Synthetic
acucagagcaaguguuugc

SEQ ID NO: 1419 - RNA, 19 nt, Artificial Sequence
  Synthetic
cucagagcaaguguuugca

SEQ ID NO: 1420 - RNA, 19 nt, Artificial Sequence
  Synthetic
ucagagcaaguguuugcac

SEQ ID NO: 1421 - RNA, 19 nt, Artificial Sequence
  Synthetic
cagagcaaguguuugcacu

SEQ ID NO: 1422 - RNA, 19 nt, Artificial Sequence
  Synthetic
agagcaaguguuugcacug

SEQ ID NO: 1423 - RNA, 19 nt, Artificial Sequence
  Synthetic
gagcaaguguuugcacugc

SEQ ID NO: 1424 - RNA, 19 nt, Artificial Sequence
  Synthetic
agcaaguguuugcacugcg

SEQ ID NO: 1425 - RNA, 19 nt, Artificial Sequence
  Synthetic
gcaaguguuugcacugcgu

SEQ ID NO: 1426 - RNA, 19 nt, Artificial Sequence
  Synthetic
caaguguuugcacugcguc

SEQ ID NO: 1427 - RNA, 19 nt, Artificial Sequence
  Synthetic
aaguguuugcacugcgucu

SEQ ID NO: 1428 - RNA, 19 nt, Artificial Sequence
  Synthetic
aguguuugcacugcgucug

SEQ ID NO: 1429 - RNA, 19 nt, Artificial Sequence
  Synthetic
guguuugcacugcgucugc

SEQ ID NO: 1430 - RNA, 19 nt, Artificial Sequence
  Synthetic
uguuugcacugcgucugca

SEQ ID NO: 1431 - RNA, 19 nt, Artificial Sequence
  Synthetic
guuugcacugcgucugcag

SEQ ID NO: 1432 - RNA, 19 nt, Artificial Sequence
  Synthetic
uuugcacugcgucugcagg

SEQ ID NO: 1433 - RNA, 19 nt, Artificial Sequence
  Synthetic
uugcacugcgucugcagga

SEQ ID NO: 1434 - RNA, 19 nt, Artificial Sequence
  Synthetic
ugcacugcgucugcaggac

SEQ ID NO: 1435 - RNA, 19 nt, Artificial Sequence
  Synthetic
gcacugcgucugcaggaca

SEQ ID NO: 1436 - RNA, 19 nt, Artificial Sequence
  Synthetic
cacugcgucugcaggacaa

SEQ ID NO: 1437 - RNA, 19 nt, Artificial Sequence
  Synthetic
acugcgucugcaggacaaa

SEQ ID NO: 1438 - RNA, 19 nt, Artificial Sequence
  Synthetic
cugcgucugcaggacaaaa

SEQ ID NO: 1439 - RNA, 19 nt, Artificial Sequence
  Synthetic
ugcgucugcaggacaaaaa

SEQ ID NO: 1440 - RNA, 19 nt, Artificial Sequence
  Synthetic
gcgucugcaggacaaaaag

SEQ ID NO: 1441 - RNA, 19 nt, Artificial Sequence
  Synthetic
cgucugcaggacaaaaagc

SEQ ID NO: 1442 - RNA, 19 nt, Artificial Sequence
  Synthetic
gucugcaggacaaaaagcu

SEQ ID NO: 1443 - RNA, 19 nt, Artificial Sequence
  Synthetic
ucugcaggacaaaaagcuc

SEQ ID NO: 1444 - RNA, 19 nt, Artificial Sequence
  Synthetic
cugcaggacaaaaagcucc

SEQ ID NO: 1445 - RNA, 19 nt, Artificial Sequence
  Synthetic
gcaggacaaaaagcuccca

SEQ ID NO: 1446 - RNA, 19 nt, Artificial Sequence
  Synthetic
caggacaaaaagcucccac

SEQ ID NO: 1447 - RNA, 19 nt, Artificial Sequence
  Synthetic
aggacaaaaagcucccacc

SEQ ID NO: 1448 - RNA, 19 nt, Artificial Sequence
  Synthetic
ggacaaaaagcucccaccg

SEQ ID NO: 1449 - RNA, 19 nt, Artificial Sequence
  Synthetic
acaaaaagcucccaccgcu

SEQ ID NO: 1450 - RNA, 19 nt, Artificial Sequence
  Synthetic
caaaaagcucccaccgcug

SEQ ID NO: 1451 - RNA, 19 nt, Artificial Sequence
  Synthetic
aaaaagcucccaccgcugc

SEQ ID NO: 1452 - RNA, 19 nt, Artificial Sequence
  Synthetic
aaaagcucccaccgcugcu

SEQ ID NO: 1453 - RNA, 19 nt, Artificial Sequence
  Synthetic
aaagcucccaccgcugcuc

SEQ ID NO: 1454 - RNA, 19 nt, Artificial Sequence
  Synthetic
aagcucccaccgcugcucu

SEQ ID NO: 1455 - RNA, 19 nt, Artificial Sequence
  Synthetic
agcucccaccgcugcucuc

SEQ ID NO: 1456 - RNA, 19 nt, Artificial Sequence
  Synthetic
gcucccaccgcugcucucu

SEQ ID NO: 1457 - RNA, 19 nt, Artificial Sequence
  Synthetic
ucccaccgcugcucucuga

SEQ ID NO: 1458 - RNA, 19 nt, Artificial Sequence
  Synthetic
ccaccgcugcucucugaga

SEQ ID NO: 1459 - RNA, 19 nt, Artificial Sequence
  Synthetic
caccgcugcucucugagau

SEQ ID NO: 1460 - RNA, 19 nt, Artificial Sequence
  Synthetic
ccgcugcucucugagaucu

SEQ ID NO: 1461 - RNA, 19 nt, Artificial Sequence
  Synthetic
cgcugcucucugagaucug

SEQ ID NO: 1462 - RNA, 19 nt, Artificial Sequence
  Synthetic
gcugcucucugagaucugg

SEQ ID NO: 1463 - RNA, 19 nt, Artificial Sequence
  Synthetic
gcucucugagaucugggau

SEQ ID NO: 1464 - RNA, 19 nt, Artificial Sequence
  Synthetic
ucucugagaucugggaugu

SEQ ID NO: 1465 - RNA, 19 nt, Artificial Sequence
  Synthetic
cucugagaucugggaugug

SEQ ID NO: 1466 - RNA, 19 nt, Artificial Sequence
  Synthetic
ucugagaucugggaugugc

SEQ ID NO: 1467 - RNA, 19 nt, Artificial Sequence
  Synthetic
cugagaucugggaugugca

SEQ ID NO: 1468 - RNA, 19 nt, Artificial Sequence
  Synthetic
ugagaucugggaugugcac

SEQ ID NO: 1469 - RNA, 19 nt, Artificial Sequence
  Synthetic
gagaucugggaugugcacg

SEQ ID NO: 1470 - RNA, 19 nt, Artificial Sequence
  Synthetic
agaucugggaugugcacga

SEQ ID NO: 1471 - RNA, 19 nt, Artificial Sequence
  Synthetic
gaucugggaugugcacgaa

SEQ ID NO: 1472 - RNA, 19 nt, Artificial Sequence
  Synthetic
aucugggaugugcacgaau

SEQ ID NO: 1473 - RNA, 19 nt, Artificial Sequence
  Synthetic
ucugggaugugcacgaaug

SEQ ID NO: 1474 - RNA, 19 nt, Artificial Sequence
  Synthetic
cugggaugugcacgaauga

SEQ ID NO: 1475 - RNA, 19 nt, Artificial Sequence
  Synthetic
ugggaugugcacgaaugac

SEQ ID NO: 1476 - RNA, 19 nt, Artificial Sequence
  Synthetic
gggaugugcacgaaugacu

SEQ ID NO: 1477 - RNA, 19 nt, Artificial Sequence
  Synthetic
ggaugugcacgaaugacug

SEQ ID NO: 1478 - RNA, 19 nt, Artificial Sequence
  Synthetic
gaugugcacgaaugacugu

SEQ ID NO: 1479 - RNA, 19 nt, Artificial Sequence
  Synthetic
ugguggcugccuccuagaa

SEQ ID NO: 1480 - RNA, 19 nt, Artificial Sequence
  Synthetic
gguggcugccuccuagaag

SEQ ID NO: 1481 - RNA, 19 nt, Artificial Sequence
  Synthetic
guggcugccuccuagaagu

SEQ ID NO: 1482 - RNA, 19 nt, Artificial Sequence
  Synthetic
uggcugccuccuagaagug

SEQ ID NO: 1483 - RNA, 19 nt, Artificial Sequence
  Synthetic
ggcugccuccuagaagugg

SEQ ID NO: 1484 - RNA, 19 nt, Artificial Sequence
  Synthetic
gcugccuccuagaagugga

SEQ ID NO: 1485 - RNA, 19 nt, Artificial Sequence
  Synthetic
cugccuccuagaaguggaa

SEQ ID NO: 1486 - RNA, 19 nt, Artificial Sequence
  Synthetic
ugccuccuagaaguggaac

SEQ ID NO: 1487 - RNA, 19 nt, Artificial Sequence
  Synthetic
gccuccuagaaguggaaca

SEQ ID NO: 1488 - RNA, 19 nt, Artificial Sequence
  Synthetic
ccuccuagaaguggaacag

SEQ ID NO: 1489 - RNA, 19 nt, Artificial Sequence
  Synthetic
cuccuagaaguggaacaga

SEQ ID NO: 1490 - RNA, 19 nt, Artificial Sequence
  Synthetic
uccuagaaguggaacagac

SEQ ID NO: 1491 - RNA, 19 nt, Artificial Sequence
  Synthetic
ccuagaaguggaacagacu

SEQ ID NO: 1492 - RNA, 19 nt, Artificial Sequence
  Synthetic
cuagaaguggaacagacug

SEQ ID NO: 1493 - RNA, 19 nt, Artificial Sequence
  Synthetic
agaaguggaacagacugag

SEQ ID NO: 1494 - RNA, 19 nt, Artificial Sequence
  Synthetic
ggaacagacugagaagggc

SEQ ID NO: 1495 - RNA, 19 nt, Artificial Sequence
  Synthetic
aacagacugagaagggcaa

SEQ ID NO: 1496 - RNA, 19 nt, Artificial Sequence
  Synthetic
acagacugagaagggcaaa

SEQ ID NO: 1497 - RNA, 19 nt, Artificial Sequence
  Synthetic
cagacugagaagggcaaac

SEQ ID NO: 1498 - RNA, 19 nt, Artificial Sequence
  Synthetic
agacugagaagggcaaaca

SEQ ID NO: 1499 - RNA, 19 nt, Artificial Sequence
  Synthetic
gacugagaagggcaaacau

SEQ ID NO: 1500 - RNA, 19 nt, Artificial Sequence
  Synthetic
acugagaagggcaaacauu

SEQ ID NO: 1501 - RNA, 19 nt, Artificial Sequence
  Synthetic
cugagaagggcaaacauuc

SEQ ID NO: 1502 - RNA, 19 nt, Artificial Sequence
  Synthetic
ugagaagggcaaacauucc

SEQ ID NO: 1503 - RNA, 19 nt, Artificial Sequence
  Synthetic
gagaagggcaaacauuccu

SEQ ID NO: 1504 - RNA, 19 nt, Artificial Sequence
  Synthetic
cccguggcauuaaaagaga

SEQ ID NO: 1505 - RNA, 19 nt, Artificial Sequence
  Synthetic
ccguggcauuaaaagagag

SEQ ID NO: 1506 - RNA, 19 nt, Artificial Sequence
  Synthetic
cguggcauuaaaagagagu

SEQ ID NO: 1507 - RNA, 19 nt, Artificial Sequence
  Synthetic
guggcauuaaaagagaguc

SEQ ID NO: 1508 - RNA, 19 nt, Artificial Sequence
  Synthetic
uggcauuaaaagagaguca

SEQ ID NO: 1509 - RNA, 19 nt, Artificial Sequence
  Synthetic
cucaaggauuucaguuaua

SEQ ID NO: 1510 - RNA, 19 nt, Artificial Sequence
  Synthetic
ucaaggauuucaguuauaa

SEQ ID NO: 1511 - RNA, 19 nt, Artificial Sequence
  Synthetic
augugcacgaaugacuguu

SEQ ID NO: 1512 - RNA, 19 nt, Artificial Sequence
  Synthetic
uauaacugaaauccuugag

SEQ ID NO: 1513 - RNA, 19 nt, Artificial Sequence
  Synthetic
uuauaacugaaauccuuga

SEQ ID NO: 1514 - RNA, 19 nt, Artificial Sequence
  Synthetic
gcucugaguggacgcugcu

SEQ ID NO: 1515 - RNA, 19 nt, Artificial Sequence
  Synthetic
aacagucauucgugcacau

SEQ ID NO: 1516 - DNA, 5874 bp, Artificial Sequence
  Synthetic
atggaattccccattggatccctcgaaactaacaacttccgtcgctttactccggagtcactggtggagatagagaagcaaattgctgccaagcagggaacaaagaaagccagagagaagcatagggagcagaaggaccaagaagagaagcctcggccccagctggacttgaaagcctgcaaccagctgcccaagttctatggtgagctcccagcagaactgatcggggagcccctggaggatctagatccgttctacagcacacaccggacatttatggtgctgaacaaagggaggaccatttcccggtttagtgccactcgggccctgtggctattcagtcctttcaacctgatcagaagaacggccatcaaagtgtctgtccactcgtggttcagtttatttattacggtcactattttggttaattgtgtgtgcatgacccgaactgaccttccagagaaaattgaatatgtcttcactgtcatttacacctttgaagccttgataaagatactggcaagaggattttgtctaaatgagttcacgtacctgagagatccttggaactggctggattttagcgtcattaccctggcatatgttggcacagcaatagatctccgtgggatctcaggcctgcggacattcagagttcttagagcattaaaaacagtttctgtgatcccaggcctgaaggtcattgtgggggccctgattcactcagtgaagaaactggctgatgtgaccatcctcaccatcttctgcctaagtgtttttgccttggtggggctgcaactcttcaagggcaacctcaaaaataaatgtgtcaagaatgacatggctgtcaatgagacaaccaactactcatctcacagaaaaccagatatctacataaataagcgaggcacttctgaccccttactgtgtggcaatggatctgactcaggccactgccctgatggttatatctgccttaaaacttctgacaacccggattttaactacaccagctttgattcctttgcttgggctttcctctcactgttccgcctcatgacacaggattcctgggaacgcctctaccagcagaccctgaggacttctgggaaaatctatatgatcttttttgtgctcgtaatcttcctgggatctttctacctggtcaacttgatcttggctgtagtcaccatggcgtatgaggagcagaaccaggcaaccactgatgaaattgaagcaaaggagaagaagttccaggaggccctcgagatgctccggaaggagcaggaggtgctagcagcactagggattgacacaacctctctccactcccacaatggatcacctttaacctccaaaaatgccagtgagagaaggcatagaataaagccaagagtgtcagagggctccacagaagacaacaaatcaccccgctctgatccttacaaccagcgcaggatgtcttttctaggcctcgcctctggaaaacgccgggctagtcatggcagtgtgttccatttccggtcccctggccgagatatctcactccctgagggagtcacagatgatggagtctttcctggagaccacgaaagccatcggggctctctgctgctgggtgggggtgctggccagcaaggccccctccctagaagccctcttcctcaacccagcaaccctgactccaggcatggagaagatgaacaccaaccgccgcccactagtgagcttgcccctggagctgtcgatgtctcggcattcgatgcaggacaaaagaagactttcttgtcagcagaatacttagatgaacctttccgggcccaaagggcaatgagtgttgtcagtatcataacctccgtccttgaggaactcgaggagtctgaacagaagtgcccaccctgcttgaccagcttgtctcagaagtatctgatctgggattgctgccccatgtgggtgaagctcaagacaattctctttgggcttgtgacggatccctttgcagagctcaccatcaccttgtgcatcgtggtgaacaccatcttcatggccatggagcaccatggcatgagccctaccttcgaagccatgctccagataggcaacatcgtctttaccatattttttactgctgaaatggtcttcaaaatcattgccttcgacccatactattatttccagaagaagtggaatatctttgactgcatcatcgtcactgtgagtctgctagagctgggcgtggccaagaagggaagcctgtctgtgctgcggagcttccgcttgctgcgcgtattcaagctggccaaatcctggcccaccttaaacacactcatcaagatcatcggaaactcagtgggggcactggggaacctcaccatcatcctggccatcattgtctttgtctttgctctggttggcaagcagctcctaggggaaaactaccgtaacaaccgaaaaaatatctccgcgccccatgaagactggccccgctggcacatgcacgacttcttccactctttcctcattgtcttccgtatcctctgtggagagtggattgagaacatgtgggcctgcatggaagttggccaaaaatccatatgcctcatccttttcttgacggtgatggtgctagggaacctggtggtgcttaacctgttcatcgccctgctattgaactctttcagtgctgacaacctcacagccccggaggacgatggggaggtgaacaacctgcaggtggccctggcacggatccaggtctttggccatcgtaccaaacaggctctttgcagcttcttcagcaggtcctgcccattcccccagcccaaggcagagcctgagctggtggtgaaactcccactctccagctccaaggctgagaaccacattgctgccaacactgccagggggagctctggagggctccaagctcccagaggccccagggatgagcacagtgacttcatcgctaatccgactgtgtgggtctctgtgcccattgctgagggtgaatctgatcttgatgacttggaggatgatggtggggaagatgctcagagcttccagcaggaagtgatccccaaaggacagcaggagcagctgcagcaagtcgagaggtgtggggaccacctgacacccaggagcccaggcactggaacatcttctgaggacctggctccatccctgggtgagacgtggaaagatgagtctgttcctcaggtccctgctgagggagtggacgacacaagctcctctgagggcagcacggtggactgcctagatcctgaggaaatcctgaggaagatccctgagctggcagatgacctggaagaaccagatgactgcttcacagaaggatgcattcgccactgtccctgctgcaaactggataccaccaagagtccatgggatgtgggctggcaggtgcgcaagacttgctaccgtatcgtggagcacagctggtttgagagcttcatcatcttcatgatcctgctcagcagtggatctctggcctttgaagactattacctggaccagaagcccacggtgaaagctttgctggagtacactgacagggtcttcacctttatctttgtgttcgagatgctgcttaagtgggtggcctatggcttcaaaaagtacttcaccaatgcctggtgctggctggacttcctcattgtgaatatctcactgataagtctcacagcgaagattctggaatattctgaagtggctcccatcaaagcccttcgaacccttcgcgctctgcggccactgcgggctctttctcgatttgaaggcatgcgggtggtggtggatgccctggtgggcgccatcccatccatcatgaatgtcctcctcgtctgcctcatcttctggctcatcttcagcatcatgggtgtgaacctcttcgcagggaagttttggaggtgcatcaactataccgatggagagttttcccttgtacctttgtcgattgtgaataacaagtctgactgcaagattcaaaactccactggcagcttcttctgggtcaatgtgaaagtcaactttgataatgttgcaatgggttaccttgcacttctgcaggtggcaacctttaaaggctggatggacattatgtatgcagctgttgattcccgggaggtcaacatgcaacccaagtgggaggacaacgtgtacatgtatttgtactttgtcatcttcatcatttttggaggcttcttcacactgaatctctttgttggggtcataattgacaacttcaatcaacagaaaaaaaagttagggggccaggacatcttcatgacagaggagcagaagaaatactacaatgccatgaagaagttgggctccaagaagccccagaagcccatcccacggcccctgaacaagttccagggttttgtctttgacatcgtgaccagacaagcttttgacatcaccatcatggtcctcatctgcctcaacatgatcaccatgatggtggagactgatgaccaaagtgaagaaaagacgaaaattctgggcaaaatcaaccagttctttgtggccgtcttcacaggcgaatgtgtcatgaagatgttcgctttgaggcagtactacttcacaaatggctggaatgtgtttgacttcattgtggtggttctctccattgcgagcctgattttttctgcaattcttaagtcacttcaaagttacttctccccaacgctcttcagagtcatccgcctggcccgaattggccgcatcctcagactgatccgagcggccaaggggatccgcacactgctctttgccctcatgatgtccctgcctgccctcttcaacatcgggctgttgctattccttgtcatgttcatctactctatcttcggtatgtccagctttccccatgtgaggtgggaggctggcatcgacgacatgttcaacttccagaccttcgccaacagcatgctgtgcctcttccagattaccacgtcggccggctgggatggcctcctcagccccatcctcaacacagggcccccctactgtgaccccaatctgcccaacagcaatggcaccagaggggactgtgggagcccagccgtaggcatcatcttcttcaccacctacatcatcatctccttcctcatcgtggtcaacatgtacattgcagtgattctggagaacttcaatgtggccacggaggagagcactgagcccctgagtgaggacgactttgacatgttctatgagacctgggagaagtttgacccagaggccactcagtttattaccttttctgctctctcggactttgcagacactctctctggtcccctgagaatcccaaaacccaatcgaaatatactgatccagatggacctgcctttggtccctggagataagatccactgcttggacatcctttttgctttcaccaagaatgtcctaggagaatccggggagttggattctctgaaggcaaatatggaggagaagtttatggcaactaatctttcaaaatcatcctatgaaccaatagcaaccactctccgatggaagcaagaagacatttcagccactgtcattcaaaaggcctatcggagctatgtgctgcaccgctccatggcactctctaacaccccatgtgtgcccagagctgaggaggaggctgcatcactcccagatgaaggttttgttgcattcacagcaaatgaaaattgtgtactcccagacaaatctgaaactgcttctgccacatcattcccaccgtcctatgagagtgtcactagaggccttagtgatagagtcaacatgaggacatctagctcaatacaaaatgaagatgaagccaccagtatggagctgattgcccctgggccctagtga

SEQ ID NO: 1517 - DNA, 22 bp, Artificial Sequence
  Synthetic
gtctctgtgcaggagatagttg

SEQ ID NO: 1518 - DNA, 21 bp, Artificial Sequence
  Synthetic
ggaggctcaccagtttcatta

SEQ ID NO: 1519 - RNA, 36 nt, Artificial Sequence; identical to SEQ ID NO: 961
  Synthetic

SEQ ID NO: 1520 - RNA, 36 nt, Artificial Sequence; identical to SEQ ID NO: 969
  Synthetic

SEQ ID NO: 1521 - RNA, 36 nt, Artificial Sequence; identical to SEQ ID NO: 971
  Synthetic

SEQ ID NO: 1522 - RNA, 36 nt, Artificial Sequence; identical to SEQ ID NO: 972
  Synthetic

SEQ ID NO: 1523 - RNA, 36 nt, Artificial Sequence; identical to SEQ ID NO: 974
  Synthetic

SEQ ID NO: 1524 - RNA, 36 nt, Artificial Sequence; identical to SEQ ID NO: 979
  Synthetic

SEQ ID NO: 1525 - RNA, 36 nt, Artificial Sequence; identical to SEQ ID NO: 984
  Synthetic

SEQ ID NO: 1526 - RNA, 36 nt, Artificial Sequence; identical to SEQ ID NO: 985
  Synthetic

SEQ ID NO: 1527 - RNA, 36 nt, Artificial Sequence; identical to SEQ ID NO: 988
  Synthetic

SEQ ID NO: 1528 - RNA, 36 nt, Artificial Sequence; identical to SEQ ID NO: 989
  Synthetic

SEQ ID NO: 1529 - RNA, 36 nt, Artificial Sequence; identical to SEQ ID NO: 990
  Synthetic

SEQ ID NO: 1530 - RNA, 36 nt, Artificial Sequence; identical to SEQ ID NO: 991
  Synthetic

SEQ ID NO: 1531 - RNA, 36 nt, Artificial Sequence; identical to SEQ ID NO: 992
  Synthetic

SEQ ID NO: 1532 - RNA, 36 nt, Artificial Sequence; identical to SEQ ID NO: 994
  Synthetic

SEQ ID NO: 1533 - RNA, 36 nt, Artificial Sequence; identical to SEQ ID NO: 1000
  Synthetic

SEQ ID NO: 1534 - RNA, 36 nt, Artificial Sequence; identical to SEQ ID NO: 1001
  Synthetic

SEQ ID NO: 1535 - RNA, 36 nt, Artificial Sequence; identical to SEQ ID NO: 1003
  Synthetic

SEQ ID NO: 1536 - RNA, 36 nt, Artificial Sequence; identical to SEQ ID NO: 1005
  Synthetic

SEQ ID NO: 1537 - RNA, 36 nt, Artificial Sequence; identical to SEQ ID NO: 1006
  Synthetic

SEQ ID NO: 1538 - RNA, 36 nt, Artificial Sequence; identical to SEQ ID NO: 1007
  Synthetic

SEQ ID NO: 1539 - RNA, 36 nt, Artificial Sequence; identical to SEQ ID NO: 1008
  Synthetic

SEQ ID NO: 1540 - RNA, 36 nt, Artificial Sequence; identical to SEQ ID NO: 1010
  Synthetic

SEQ ID NO: 1541 - RNA, 36 nt, Artificial Sequence; identical to SEQ ID NO: 1011
  Synthetic

SEQ ID NO: 1542 - RNA, 36 nt, Artificial Sequence; identical to SEQ ID NO: 1012
  Synthetic

SEQ ID NO: 1543 - RNA, 36 nt, Artificial Sequence; identical to SEQ ID NO: 1013
  Synthetic

SEQ ID NO: 1544 - RNA, 36 nt, Artificial Sequence; identical to SEQ ID NO: 1014
  Synthetic

SEQ ID NO: 1545 - RNA, 36 nt, Artificial Sequence; identical to SEQ ID NO: 1015
  Synthetic

SEQ ID NO: 1546 - RNA, 36 nt, Artificial Sequence; identical to SEQ ID NO: 1016
  Synthetic

SEQ ID NO: 1547 - RNA, 36 nt, Artificial Sequence; identical to SEQ ID NO: 1017
  Synthetic

SEQ ID NO: 1548 - RNA, 36 nt, Artificial Sequence; identical to SEQ ID NO: 1021
  Synthetic

SEQ ID NO: 1549 - RNA, 36 nt, Artificial Sequence; identical to SEQ ID NO: 1023
  Synthetic

SEQ ID NO: 1550 - RNA, 36 nt, Artificial Sequence; identical to SEQ ID NO: 1030
  Synthetic

SEQ ID NO: 1551 - RNA, 36 nt, Artificial Sequence; identical to SEQ ID NO: 1031
  Synthetic

SEQ ID NO: 1552 - RNA, 36 nt, Artificial Sequence; identical to SEQ ID NO: 1032
  Synthetic

The invention claimed is:

1. A double stranded RNAi oligonucleotide (dsRNAi) for reducing NR1H3 expression, comprising a sense strand and an antisense strand, wherein the sense strand and the antisense strand form a duplex region, and wherein
   (i) the sense and antisense strands comprise the nucleotide sequences set forth in SEQ ID NOs: 786 and 874, respectively;
   (ii) the sense and antisense strands comprise the nucleotide sequences set forth in SEQ ID NOs: 787 and 875, respectively;
   (iii) the sense and antisense strands comprise the nucleotide sequences set forth in SEQ ID NOs: 1537 and 929, respectively; or
   (iv) the sense and antisense strands comprise the nucleotide sequences set forth in SEQ ID NOs: 813 and 901, respectively.

2. The double stranded RNAi oligonucleotide (dsRNAi) of claim 1, wherein the sense and antisense strands comprise the nucleotide sequences set forth in SEQ ID NOs: 786 and 874, respectively.

3. The double stranded RNAi oligonucleotide (dsRNAi) of claim 1, wherein the sense and antisense strands comprise the nucleotide sequences set forth in SEQ ID NOs: 787 and 875, respectively.

4. The double stranded RNAi oligonucleotide (dsRNAi) of claim 1, wherein the sense and antisense strands comprise the nucleotide sequences set forth in SEQ ID NOs: 1537 and 929, respectively.

5. The double stranded RNAi oligonucleotide (dsRNAi) of claim 1, wherein the sense and antisense strands comprise the nucleotide sequences set forth in SEQ ID NOs: 813 and 901, respectively.

6. The double stranded RNAi oligonucleotide (dsRNAi) of claim 1, wherein the 3' end of the sense strand comprises a stem-loop set forth as S1-L-S2, and wherein
   (i) S1 is complementary to S2, and S1 and S2 have the same length and are each 1-10 nucleotides in length; and
   (ii) L forms a loop between S1 and S2 of 3-5 nucleotides in length.

7. The double stranded RNAi oligonucleotide (dsRNAi) of claim 6, wherein
   (i) S1 and S2 are 6 nucleotides in length; and
   (ii) L is a triloop or a tetraloop.

8. The double stranded RNAi oligonucleotide (dsRNAi) of claim 7, wherein L is a tetraloop comprising the sequence 5'-GAAA-3'.

9. The double stranded RNAi oligonucleotide (dsRNAi) of claim 6, wherein the stem-loop comprises the sequence 5'-GCAGCCGAAAGGCUGC-3' (SEQ ID NO: 1121).

10. The double stranded RNAi oligonucleotide (dsRNAi) of claim 6, wherein at least one nucleotide of the oligonucleotide is conjugated to one or more targeting ligands.

11. The double stranded RNAi oligonucleotide (dsRNAi) of claim 10, wherein each targeting ligand comprises a carbohydrate, amino sugar, cholesterol, polypeptide or lipid.

12. The double stranded RNAi oligonucleotide (dsRNAi) of claim 10, wherein the targeting ligand is a hepatocyte targeting ligand and each targeting ligand comprises a N-acetylgalactosamine (GalNAc) moiety.

13. The double stranded RNAi oligonucleotide (dsRNAi) of claim 12, wherein the N-acetylgalactosamine (GalNAc) moiety is a monovalent GalNAc moiety, a bivalent GalNAc moiety, a trivalent GalNAc moiety or a tetravalent GalNAc moiety.

14. The double stranded RNAi oligonucleotide (dsRNAi) of claim 10, wherein the stem loop comprises one or more targeting ligands conjugated to one or more nucleotides of the stem loop or the loop comprises one or more targeting ligands conjugated to one or more nucleotides of the loop.

15. The double stranded RNAi oligonucleotide (dsRNAi) of claim 14, wherein the one or more targeting ligands is conjugated to one or more nucleotides of the loop, wherein the loop comprises 4 nucleotides numbered 1-4 from 5' to 3', wherein nucleotides at positions 2, 3, and 4 each comprise one or more targeting ligands, and wherein the targeting ligands are the same or different.

16. The double stranded RNAi oligonucleotide (dsRNAi) of claim 14, wherein the targeting ligand is a hepatocyte targeting ligand and each targeting ligand comprises a N-acetylgalactosamine (GalNAc) moiety.

17. The double stranded RNAi oligonucleotide (dsRNAi) of claim 16, wherein the N-acetylgalactosamine (GalNAc) moiety is a monovalent GalNAc moiety, a bivalent GalNAc moiety, a trivalent GalNAc moiety or a tetravalent GalNAc moiety.

18. The double stranded RNAi oligonucleotide (dsRNAi) of claim 14, wherein the targeting ligand is a hepatocyte targeting ligand and up to 4 nucleotides of L of the stem-loop are each conjugated to a monovalent GalNAc moiety.

19. The double stranded RNAi oligonucleotide (dsRNAi) of claim 6, comprising at least one modified nucleotide and said modified nucleotide comprises a 2'-modification selected from the group consisting of 2'-aminoethyl, 2'-fluoro, 2'-O-methyl, 2'-O-methoxyethyl, and 2'-deoxy-2'-fluoro-β-d-arabinonucleic acid.

20. The double stranded RNAi oligonucleotide (dsRNAi) of claim 19, wherein all nucleotides of the oligonucleotide are modified, and the modification is 2'-fluoro and 2'-O-methyl.

21. The double stranded RNAi oligonucleotide (dsRNAi) of claim 19, wherein the sense strand comprises 36 nucleotides with positions 1-36 from 5' to 3', wherein positions 8-11 comprise a 2'-fluoro modification; the antisense strand comprises 22 nucleotides with positions 1-22 from 5' to 3', and wherein positions 2, 3, 4, 5, 7, 10, and 14 comprise a 2'-fluoro modification; and the remaining nucleotides comprise a 2'-O-methyl modification.

22. The double stranded RNAi oligonucleotide (dsRNAi) of claim 21, wherein (i) the oligonucleotide comprises at least one phosphorothioate linkage, wherein
   (a) the antisense strand comprises a phosphorothioate linkage (i) between positions 1 and 2, and between positions 2 and 3; or (ii) between positions 1 and 2, between positions 2 and 3, and between positions 3 and 4, wherein positions are numbered 1-4 from 5' to 3'; or
   (b) the antisense strand is 22 nucleotides in length, and wherein the antisense strand comprises a phosphorothioate linkage between positions 20 and 21 and between positions 21 and 22, wherein positions are numbered 1-22 from 5' to 3', or
   (ii) the antisense strand comprises a phosphorylated nucleotide at the 5' terminus, selected from uridine and adenosine, or
   (iii) the 4'-carbon of the sugar of the 5'-nucleotide of the antisense strand comprises a phosphate analog, wherein the phosphate analog is a 4'-phosphate analog comprising 5'-methoxyphosphonate-4'-oxy, or
   (iv) the antisense strand comprises an overhang sequence at the 3' terminus, and wherein the overhang sequence is 2 nucleotides in length selected from the group consisting of AA, GG, AG, and GA.

23. A double stranded RNAi oligonucleotide (dsRNAi) for reducing NR1H3 expression, comprising a sense strand and an antisense strand, wherein the sense strand and the antisense strand form a duplex region, wherein (i) the sense strand comprises the sequence and all of the modifications of 5'-mCs-mU-mC-mA-mA-mG-mG-fA-fU-fU-fU-mC-mA-mG-mU-mU-mA-mU-mA-mA-mG-mC-mA-mG-mC-mC-mG-[ademA-GalNAc]-[ademA-GalNAc]-[ademA-GalNAc]-mG-mG-mC-mU-mG-mC-3' (SEQ ID NO: 963), and wherein the antisense strand comprises the sequence and all of the modifications of 5'-[MePhosphonate-40-mUs]-fUs-fAs-fU-fA-mA-fC-mU-mG-fA-mA-mA-mU-fC-mC-mU-mU-mG-mA-mGs-mGs-mG-3' (SEQ ID NO: 1051), wherein mC, mA, mG, and mU=2'-OMe ribonucleosides; fA, fC, fG, and fU=2'-F ribonucleosides; s=phosphorothioate, and wherein ademA-GalNAc=

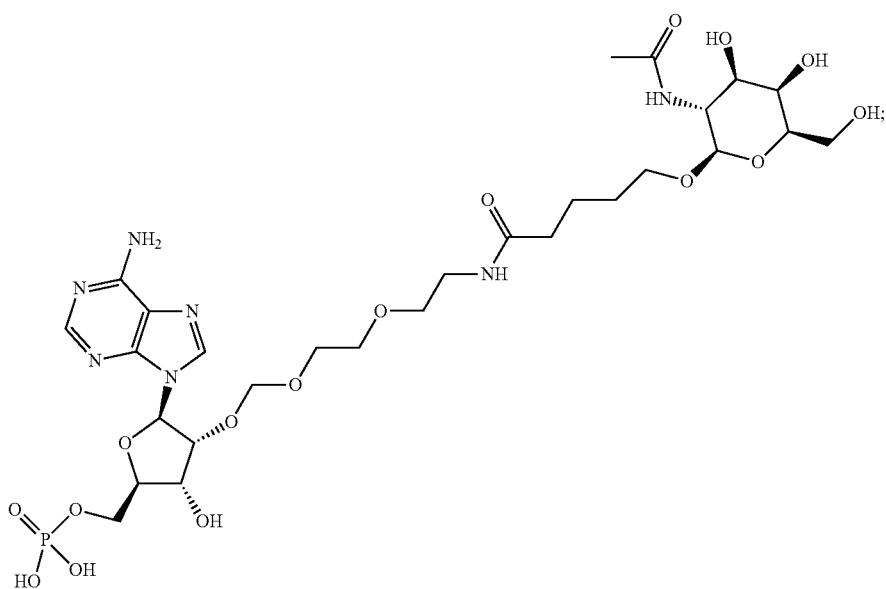 [SMILES: CC(=O)N[C@H]1[C@H](OCCCCC(=O)NCCOCCOCO[C@@H]2[C@H](O)[C@@H](COP(=O)(O)O)O[C@H]2n2cnc3c(N)ncnc32)O[C@H](CO)[C@H](O)[C@@H]1O]

(ii) the sense strand comprises the sequence and all of the modifications of 5'-mUs-mC-mA-mA-mG-mG-mA-fU-fU-fU-fC-mA-mG-mU-mU-mA-mU-mA-mA-mA-mG-mC-mA-mG-mC-mC-mG-[ademA-GalNAc]-[ademA-GalNAc]-[ademA-GalNAc]-mG-mG-mC-mU-mG-mC-3' (SEQ ID NO: 964), and wherein the antisense strand comprises the sequence and all of the modifications of 5'-[MePhosphonate-40-mUs]-fUs-fUs-fA-fU-mA-fA-mC-mU-fG-mA-mA-mA-fU-mC-mC-mU-mU-mG-mAs-mGs-mG-3' (SEQ ID NO: 1052), wherein mC, mA, mG, and mU=2'-OMe ribonucleosides; fA, fC, fG, and fU=2'-F ribonucleosides; s=phosphorothioate, and wherein ademA-GalNAc=

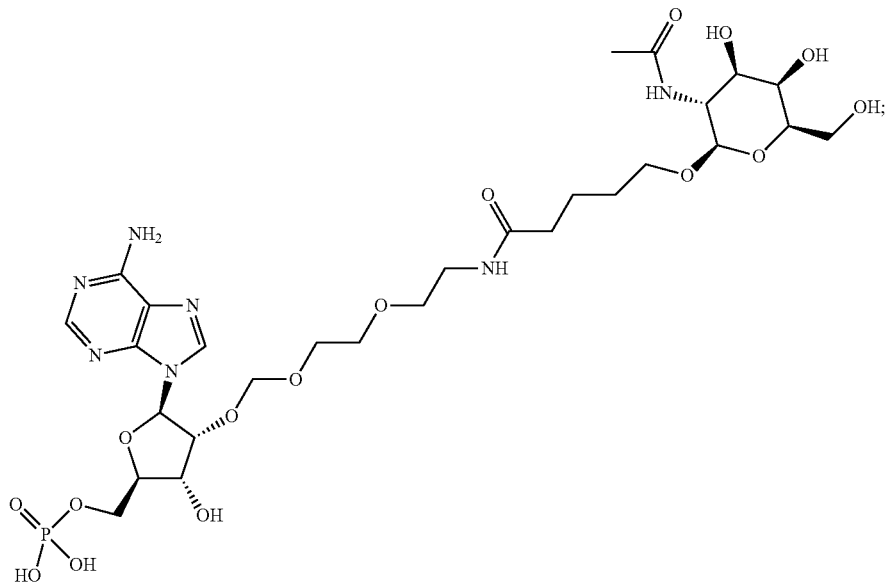 [SMILES: CC(=O)N[C@H]1[C@H](OCCCCC(=O)NCCOCCOCO[C@@H]2[C@H](O)[C@@H](COP(=O)(O)O)O[C@H]2n2cnc3c(N)ncnc32)O[C@H](CO)[C@H](O)[C@@H]1O]

(iii) the sense strand comprises the sequence and all of the modifications of 5'-mAs-mG-mC-mA-mG-mC-mG-fU-fC-fC-fA-mC-mU-mC-mA-mG-mA-mG-mC-mA-mG-mC-mA-mG-mC-mC-mG-[ademA-GalNAc]-[ademA-GalNAc]-[ademA-GalNAc]-mG-mG-mC-mU-mG-mC-3' (SEQ ID NO: 1006), and wherein the antisense strand comprises the sequence and all of the modifications of 5'-[MePhosphonate-40-mUs]-fGs-fCs-fU-fC-mU-fG-mA-mG-fU-mG-mG-mA-fC-mG-mC-mU-mG-mC-mUs-mGs-mG-3' (SEQ ID NO: 1094), wherein mC, mA, mG, and mU=2'-OMe ribonucleosides; fA, fC, fG, and fU=2'-F ribonucleosides; s=phosphorothioate, and wherein ademA-GalNAc=

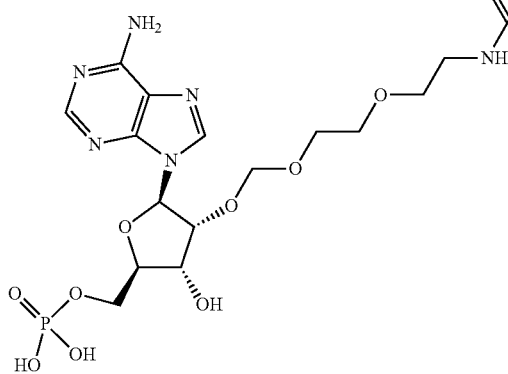

(iv) the sense strand comprises the sequence and all of the modifications of 5'-mAs-mU-mG-mU-mG-mC-mA-fC-fG-fA-fA-mU-mG-mA-mC-mU-mG-mU-mU-mA-mG-mC-mA-mG-mC-mC-mG-[ademA-GalNAc]-[ademA-GalNAc]-[ademA-GalNAc]-mG-mG-mC-mU-mG-mC-3' (SEQ ID NO: 1018), and wherein the antisense strand comprises the sequence and all of the modifications of 5'-[MePhosphonate-40-mUs]-fAs-fAs-fC-fA-mG-fU-mC-mA-fU-mU-mC-mG-fU-mG-mC-mA-mC-mA-mUs-mGs-mG-3' (SEQ ID NO: 1106), wherein mC, mA, mG, and mU=2'-OMe ribonucleosides; fA, fC, fG, and fU=2'-F ribonucleosides; s=phosphorothioate, and wherein ademA-GalNAc=

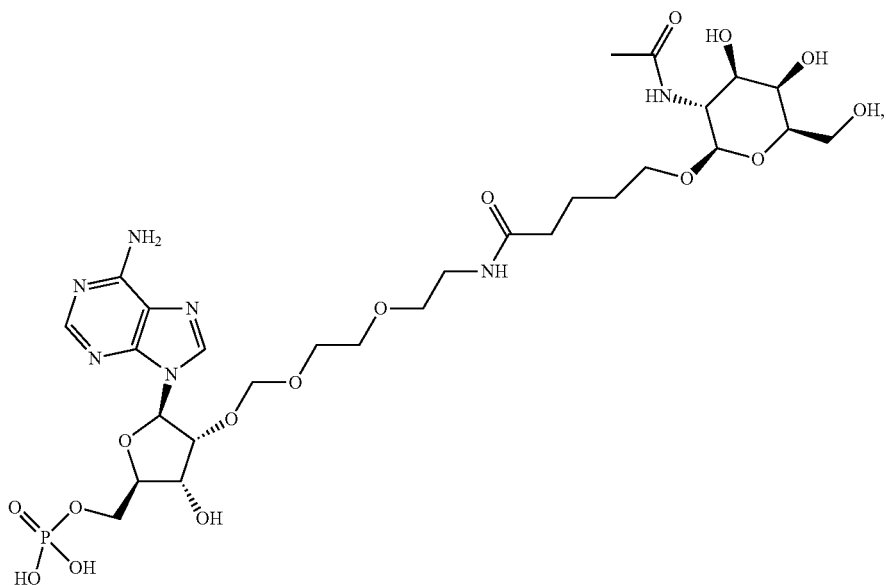 [SMILES: CC(=O)N[C@H]1[C@H](OCCCCC(=O)NCCOCCOCO[C@@H]2[C@H](O)[C@@H](COP(=O)(O)O)O[C@H]2n2cnc3c(N)ncnc32)O[C@H](CO)[C@H](O)[C@@H]1O]

optionally wherein the oligonucleotide is a Dicer substrate.

24. The double stranded RNAi oligonucleotide (dsRNAi) of claim 23, wherein the sense strand comprises the sequence and all of the modifications of 5'-mCs-mU-mC-mA-mA-mG-mG-fA-fU-fU-fU-mC-mA-mG-mU-mU-mA-mU-mA-mA-mG-mC-mA-mG-mC-mC-mG-[ademA-GalNAc]-[ademA-GalNAc]-[ademA-GalNAc]-mG-mG-mC-mU-mG-mC-3' (SEQ ID NO: 963), and wherein the antisense strand comprises the sequence and all of the modifications of 5'-[MePhosphonate-40-mUs]-fUs-fAs-fU-fA-mA-fC-mU-mG-fA-mA-mA-mU-fC-mC-mU-mU-mG-mA-mGs-mGs-mG-3' (SEQ ID NO: 1051), wherein mC, mA, mG, and mU=2'-OMe ribonucleosides; fA, fC, fG, and fU=2'-F ribonucleosides; s=phosphorothioate, and wherein ademA-GalNAc=

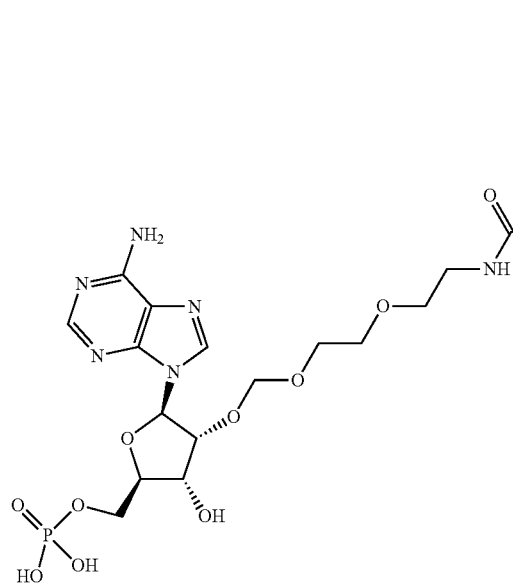

optionally wherein the oligonucleotide is a Dicer substrate.

25. The double stranded RNAi oligonucleotide (dsRNAi) of claim 23, wherein the sense strand comprises the sequence and all of the modifications of 5'-mUs-mC-mA-mA-mG-mG-mA-fU-fU-fU-fC-mA-mG-mU-mU-mA-mU-mA-mA-mA-mG-mC-mA-mG-mC-mC-mG-[ademA-GalNAc]-[ademA-GalNAc]-[ademA-GalNAc]-mG-mG-mC-mU-mG-mC-3' (SEQ ID NO: 964), and wherein the antisense strand comprises the sequence and all of the modifications of 5'-[MePhosphonate-40-mUs]-fUs-fUs-fA-fU-mA-fA-mC-mU-fG-mA-mA-mA-fU-mC-mC-mU-mU-mG-mAs-mGs-mG-3' (SEQ ID NO: 1052), wherein mC, mA, mG, and mU=2'-OMe ribonucleosides; fA, fC, fG, and fU=2'-F ribonucleosides; s=phosphorothioate, and wherein ademA-GalNAc=

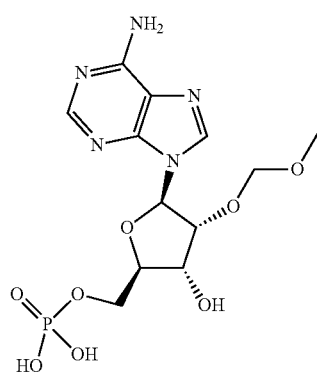

optionally wherein the oligonucleotide is a Dicer substrate.

26. The double stranded RNAi oligonucleotide (dsRNAi) of claim 23, wherein the sense strand comprises the sequence and all of the modifications of 5'-mAs-mG-mC-mA-mG-mC-mG-fU-fC-fC-fA-mC-mU-mC-mA-mG-mA-mG-mC-mA-mG-mC-mA-mG-mC-mC-mG-[ademA-GalNAc]-[ademA-GalNAc]-[ademA-GalNAc]-mG-mG-mC-mU-mG-mC-3' (SEQ ID NO: 1006), and wherein the antisense strand comprises the sequence and all of the modifications of 5'-[MePhosphonate-40-mUs]-fGs-fCs-fU-fC-mU-fG-mA-mG-fU-mG-mG-mA-fC-mG-mC-mU-mG-mC-mUs-mGs-mG-3' (SEQ ID NO: 1094), wherein mC, mA, mG, and mU=2'-OMe ribonucleosides; fA, fC, fG, and fU=2'-F ribonucleosides; s=phosphorothioate, and wherein ademA-GalNAc=

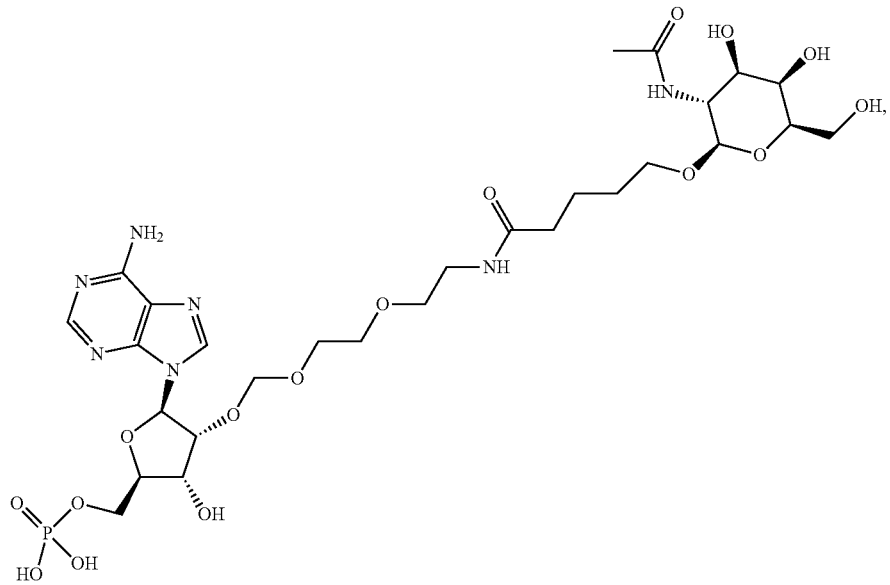 [SMILES: CC(=O)N[C@H]1[C@H](OCCCCC(=O)NCCOCCOCO[C@@H]2[C@H](O)[C@@H](COP(=O)(O)O)O[C@H]2n2cnc3c(N)ncnc32)O[C@H](CO)[C@H](O)[C@@H]1O]

optionally wherein the oligonucleotide is a Dicer substrate.

27. The double stranded RNAi oligonucleotide (dsRNAi) of claim 23, wherein the sense strand comprises the sequence and all of the modifications of 5'-mAs-mU-mG-mU-mG-mC-mA-fC-fG-fA-fA-mU-mG-mA-mC-mU-mG-mU-mA-mG-mC-mA-mG-mC-mC-mG-[ademA-GalNAc]-[ademA-GalNAc]-[ademA-GalNAc]-mG-mG-mC-mU-mG-mC-3' (SEQ ID NO: 1018), and wherein the antisense strand comprises the sequence and all of the modifications of 5'-[MePhosphonate-40-mUs]-fAs-fAs-fC-fA-mG-fU-mC-mA-fU-mU-mC-mG-fU-mG-mC-mA-mC-mA-mUs-mGs-mG-3' (SEQ ID NO: 1106), wherein mC, mA, mG, and mU=2'-OMe ribonucleosides; fA, fC, fG, and fU=2'-F ribonucleosides; s=phosphorothioate, and wherein ademA-GalNAc=

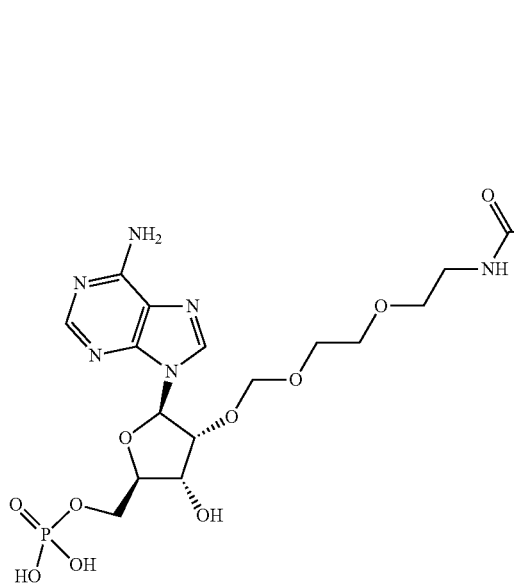

optionally wherein the oligonucleotide is a Dicer substrate.

28. A pharmaceutical composition comprising a double stranded RNAi oligonucleotide of claim 23, and a pharmaceutically acceptable carrier, delivery agent or excipient.

29. A method of treating non-alcoholic fatty liver disease (NAFLD), non-alcoholic steatohepatitis (NASH), multiple sclerosis, or systemic lupus erythematosus, comprising administering to a patient in need thereof a double stranded RNAi oligonucleotide of claim 23.

30. A method of treating non-alcoholic fatty liver disease (NAFLD), non-alcoholic steatohepatitis (NASH), multiple sclerosis, or systemic lupus erythematosus, comprising administering to a patient in need thereof the pharmaceutical composition of claim 28.

* * * * *